(12) United States Patent
Yuen et al.

(10) Patent No.: US 7,553,944 B2
(45) Date of Patent: *Jun. 30, 2009

(54) HUMAN VIRUS CAUSING RESPIRATORY TRACT INFECTION AND USES THEREOF

(75) Inventors: Kwok Yung Yuen, Hong Kong (CN); Chiu Yat Patrick Woo, Hong Kong (CN); Kar Pui Susanna Lau, Hong Kong (CN); Kwok Hung Chan, Hong Kong (CN); Lit Man Poon, Hong Kong (CN); Joseph Sriyal Malik Peiris, Hong Kong (CN); Yi Guan, Hong Kong (CN)

(73) Assignee: The University of Hong Kong, Hong Kong (CN)

( * ) Notice: Subject to any disclaimer, the term of this patent is extended or adjusted under 35 U.S.C. 154(b) by 422 days.

This patent is subject to a terminal disclaimer.

(21) Appl. No.: 10/895,064

(22) Filed: Jul. 21, 2004

(65) Prior Publication Data

US 2006/0018923 A1   Jan. 26, 2006

(51) Int. Cl.
*C07H 21/02* (2006.01)
*C12N 15/00* (2006.01)
*A61K 39/00* (2006.01)
*A61K 39/12* (2006.01)

(52) U.S. Cl. ............... 536/23.1; 435/320.1; 530/185.1; 530/186.1

(58) Field of Classification Search ....................... None
See application file for complete search history.

(56) References Cited

U.S. PATENT DOCUMENTS

2005/0266397 A1   12/2005   Ecker et al.

OTHER PUBLICATIONS

Yount B. et al. "Systematic assembly of a full-length infectious cDNA of mouse hepatitis virus strain A59", J Virol. Nov. 2002;76(21):11065-78.*
Entraz Accession No. NC_001846.*
Woo PC et al. "Phylogenetic and recombination analysis of coronavirus HKU1, a novel coronavirus from patients with pneumonia". Arch Virol. Nov. 2005;150(11):2299-311.*
Zhao P. et al "DNA vaccine of SARS-Cov S gene induces antibody response in mice". Acta Biochim Biophys Sin (Shanghai). Jan. 2004;36(1):37-41. See marked p. 1-4.*
Marra Ma et al "The Genome sequence of the SARS-associated coronavirus". Science. May 30, 2003;300(5624):1399-404. Epub May 1, 2003.*
Cavanagh D. "Severe acute respiratory syndrome vaccine development: experiences of vaccination against avian infectious bronchitis coronavirus". Avian Pathol. Dec. 2003;32(6):567-82.*

* cited by examiner

*Primary Examiner*—Bo Peng
(74) *Attorney, Agent, or Firm*—Saliwanchik, Lloyd & Saliwanchik

(57) ABSTRACT

The present invention provides the complete genomic sequence of a novel human coronavirus, coined as coronavirus-HKU1 ("CoV-HKU1"), isolated in Hong Kong from a patient who had a recent history of visit to Schenzhen, China. The virus belongs to the order Nidovirales of the family Coronaviridae, being a single-stranded RNA virus of positive polarity. The invention also provides the deduced amino acid sequences of the complete genome of the CoV-HKU1. The nucleotide sequences and deduced amino acid sequences of the CoV-HKU1 are useful in preventing, diagnosing and/or treating the infection by CoV-HKU1. Furthermore, the invention provides immunogenic and vaccine preparations using recombinant and chimeric forms as well as subunits of the CoV-HKU1 based on the nucleotide sequences and deduced amino acid sequences of the CoV-HKU1.

14 Claims, 119 Drawing Sheets

Figure 4:
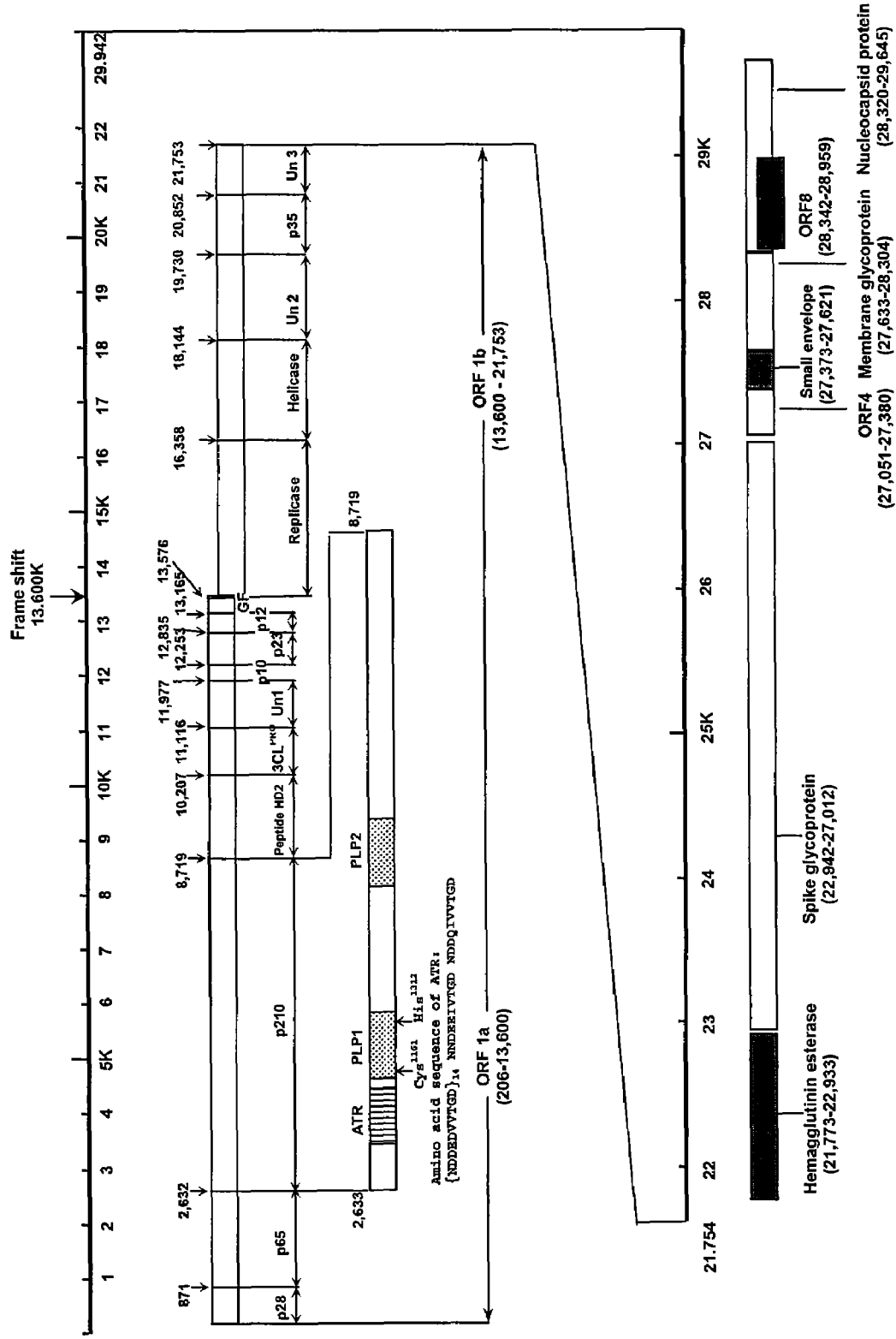

```
SEQ:1    1        TCGTGCTATGCCAAATATTTTGCGTATTGTTAGTAGTTTAGTTTTGGCCCGCAAACAT         58
SEQ:2    1           R   A   M   P   N   I   L   R   I   V   S   S   L   V   L   A   R   K   H      19

59       GAATTTTGTTGTTCACATGGTGATAGATTTTATCGCCTTGCGAATGAATGTGCTCAAGTT        118
         20          E   F   C   C   S   H   G   D   R   F   Y   R   L   A   N   E   C   A   Q   V   39

119      TTGAGTGAAATAGTTATGTGTGGCGGTTGCTATTATGTTAAGCCTGGTGGTACTAGCAGT        178
         40          L   S   E   I   V   M   C   G   G   C   Y   Y   V   K   P   G   G   T   S   S   59

179      GGTGATGCAACTACTGCTTTTGCTAATTCTGTTTTTAATATATGTCAGGCTGTTACTGCT        238
         60          G   D   A   T   T   A   F   A   N   S   V   F   N   I   C   Q   A   V   T   A   79

239      AATGTTTGTTCTCTTATGGCCTGTAATGGCCATAAGATTGAAGATTTAAGTATACGCAAT        298
         80          N   V   C   S   L   M   A   C   N   G   H   K   I   E   D   L   S   I   R   N   99

299      TTACAAAAACGCTTATACTCTAATGTTTATCGTACAGATTATGTTGATTATACATTTGTT        358
         100         L   Q   K   R   L   Y   S   N   V   Y   R   T   D   Y   V   D   Y   T   F   V  119

359      AATGAGTATTATGAATTTTTATGTAAGCATTTTAG                                 393
         120         N   E   Y   Y   E   F   L   C   K   H   F                          130
```

FIG. 1

```
SEQ:3    1    GAATAAGAGCGAATTGCGTCCGTACCGTCTATCAGCTTACGATCTCTTGTCAGATCTCAT    60
              E * E R I A S V P S I S L R S L V R S H
               N K S E L R P Y R L S A Y D L L S D L I
                I R A N C V R T V Y Q L T I S C Q I S L

61    TAAATCTAAACTTTTTAAACAAGATTCCCTGTTATCCATGCTTGTGAGTGTGGTTTAATC   120
              * I * T F * T R F P V I H A C E C G L I
               K S K L F K Q D S L L S M L V S V V * S
                N L N F L N K I P C Y P C L * V W F N H

121    ATAATCTTGTATTTTACTTTCCACACTTTTCATCTCTCTGCCAGTGACGTGTTGGTTGTC   180
              I I L Y F T F H T F H L S A S D V L V V
               * S C I L L S T L F I S L P V T C W L S
                N L V F Y F P H F S S L C Q * R V G C P

181    CTCAGCGTCCCTCCCATAGGTCGCAATGATTAAAACCAGCAAATACGGTCTCGGCTTCAA   240
              L S V P P I G R N D * N Q Q I R S R L Q
               S A S L P * V A M I K T S K Y G L G F K
                Q R P S H R S Q * L K P A N T V S A S S

241    GTGGGCGCCAGAATTTCGTTGGCTGCTTCCGGATGCAGCGGAGGAGTTGGCTAGTCCTAT   300
              V G A R I S L A A S G C S G G V G * S Y
               W A P E F R W L L P D A A E E L A S P M
                G R Q N F V G C F R M Q R R S W L V L *

301    GAAGTCAGATGAGGGTGGGTTATGCCCCTCTACTGGTCAAGCGATGGAAAGTGTTGGATT   360
              E V R * G W V M P L Y W S S D G K C W I
               K S D E G G L C P S T G Q A M E S V G F
                S Q M R V G Y A P L L V K R W K V L D S

361    CGTTTATGATAATCATGTGAAGATAGATTGTCGCTGCATTCTTGGACAAGAATGGCATGT   420
              R L * * S C E D R L S L H S W T R M A C
               V Y D N H V K I D C R C I L G Q E W H V
                F M I I M * R * I V A A F L D K N G M C

421    GCAGTCAAATCTTATCCGTGATATTTTTGTTCATGAAGATCTACATGTTGTAGAAGTTCT   480
              A V K S Y P * Y F C S * R S T C C R S S
               Q S N L I R D I F V H E D L H V V E V L
                S Q I L S V I F L F M K I Y M L * K F *

481    AACTAAAACAGCCGTAAAGTCCGGTACGGCAATTTTAATTAAATCACCTTTGCATAGCTT   540
              N * N S R K V R Y G N F N * I T F A * L
               T K T A V K S G T A I L I K S P L H S L
                L K Q P * S P V R Q F * L N H L C I A W
```

FIG. 2

```
541  GGGTGGTTTTCCTAAAGGGTATGTTATGGGCTTGTTCCGTTCATACAAGACTAAACGTTA  600
      G  W  F  S  *  R  V  C  Y  G  L  V  P  F  I  Q  D  *  T  L
       G  G  F  P  K  G  Y  V  M  G  L  F  R  S  Y  K  T  K  R  Y
        V  V  F  L  K  G  M  L  W  A  C  S  V  H  T  R  L  N  V  M

601  TGTTGTACATCATCTTTCTATGACTACATCTACTACTAATTTTGGTGAAGATTTTTTGGG  660
      C  C  T  S  S  F  Y  D  Y  I  Y  Y  *  F  W  *  R  F  F  G
       V  V  H  H  L  S  M  T  T  S  T  T  N  F  G  E  D  F  L  G
        L  Y  I  I  F  L  *  L  H  L  L  L  I  L  V  K  I  F  W  V

661  TTGGATTGTACCTTTTGGTTTTATGCCATCTTATGTTCACAAATGGTTTCAATTCTGTAG  720
      L  D  C  T  F  W  F  Y  A  I  L  C  S  Q  M  V  S  I  L  *
       W  I  V  P  F  G  F  M  P  S  Y  V  H  K  W  F  Q  F  C  R
        G  L  Y  L  L  V  L  C  H  L  M  F  T  N  G  F  N  S  V  G

721  GTTGTATATTGAAGAGAGTGATTTAATAATTTCAAATTTTAAATTTGATGATTATGATTT  780
      V  V  Y  *  R  E  *  F  N  N  F  K  F  *  I  *  *  L  *  F
       L  Y  I  E  E  S  D  L  I  I  S  N  F  K  F  D  D  Y  D  F
        C  I  L  K  R  V  I  *  *  F  Q  I  L  N  L  M  I  M  I  L

781  TAGTGTAGAAGATGCTTATGCTGAGGTTCATGCTGAGCCTAAAGGTAAATATTCACAAAA  840
      *  C  R  R  C  L  C  *  G  S  C  *  A  *  R  *  I  F  T  K
       S  V  E  D  A  Y  A  E  V  H  A  E  P  K  G  K  Y  S  Q  K
        V  *  K  M  L  M  L  R  F  M  L  S  L  K  V  N  I  H  K  K

841  AGCTTATGCTTTACTTAGACAATATCGTGGTATTAAACCCGTACTTTTTGTAGACCAGTA  900
      S  L  C  F  T  *  T  I  S  W  Y  *  T  R  T  F  C  R  P  V
       A  Y  A  L  L  R  Q  Y  R  G  I  K  P  V  L  F  V  D  Q  Y
        L  M  L  Y  L  D  N  I  V  V  L  N  P  Y  F  L  *  T  S  M

901  TGGTTGTGACTATTCTGGTAAATTAGCAGATTGTCTTCAAGCTTATGGTCATTATTCTTT  960
      W  L  *  L  F  W  *  I  S  R  L  S  S  S  L  W  S  L  F  F
       G  C  D  Y  S  G  K  L  A  D  C  L  Q  A  Y  G  H  Y  S  L
        V  V  T  I  L  V  N  *  Q  I  V  F  K  L  M  V  I  I  L  C

961  GCAAGATATGAGACAAAAGCAGTCTGTATGGCTTGCCAATTGTGACTTTGATATTGTAGT  1020
      A  R  Y  E  T  K  A  V  C  M  A  C  Q  L  *  L  *  Y  C  S
       Q  D  M  R  Q  K  Q  S  V  W  L  A  N  C  D  F  D  I  V  V
        K  I  *  D  K  S  S  L  Y  G  L  P  I  V  T  L  I  L  *  W

1021 GGCTTGGCATGTAGTTCGTGATTCACGATTTGTTATGCGCCTGCAGACTATAGCTACTAT  1080
      G  L  A  C  S  S  *  F  T  I  C  Y  A  P  A  D  Y  S  Y  Y
       A  W  H  V  V  R  D  S  R  F  V  M  R  L  Q  T  I  A  T  I
        L  G  M  *  F  V  I  H  D  L  L  C  A  C  R  L  *  L  L  F
```

FIG. 2 CONT'D

```
1081    TTGTGGTATTAAATATGTTGCACAACCTACAGAAGATGTAGTAGATGGAGATGTAGTTAT    1140
        L W Y * I C C T T Y R R C S R W R C S Y
          C G I K Y V A Q P T E D V V D G D V V I
            V V L N M L H N L Q K M * * M E M * L Y

1141    ACGTGAACCTGTACATTTATTATCTGCTGATGCAATAGTTTTAAAGCTTCCTAGTTTGAT    1200
        T * T C T F I I C * C N S F K A S * F D
          R E P V H L L S A D A I V L K L P S L M
            V N L Y I Y Y L L M Q * F * S F L V * *

1201    GAAAGTTATGACTCATATGGATGATTTTCTATTAAATCTATATATAATGTTGATTTGTG    1260
        E S Y D S Y G * F F Y * I Y I * C * F V
          K V M T H M D D F S I K S I Y N V D L C
            K L * L I W M I F L L N L Y I M L I C V

1261    TGATTGTGGTTTTGTTATGCAGTATGGTTATGTAGATTGTTTTAATGATAATTGTGATTT    1320
        * L W F C Y A V W L C R L F * * * L * F
          D C G F V M Q Y G Y V D C F N D N C D F
            I V V L L C S M V M * I V L M I I V I F

1321    TTATGGTTGGGTTTCAGGTAATATGATGGATGGTTTTTCTTGTCCATTGTGTTGTACAGT    1380
        L W L G F R * Y D G W F F L S I V L Y S
          Y G W V S G N M M D G F S C P L C C T V
            M V G F Q V I * W M V F L V H C V V Q F

1381    TTATGACTCTAGCGAAGTTAAAGCCCAATCATCTGGTGTTATTCCTGAAAATCCTGTGTT    1440
        L * L * R S * S P I I W C Y S * K S C V
          Y D S S E V K A Q S S G V I P E N P V L
            M T L A K L K P N H L V L F L K I L C Y

1441    ATTTACTAATAGTACTGATACTGTTAACCATGATTCTTTTAATTTGTATGGTTATTCTGT    1500
        I Y * * Y * Y C * P * F F * F V W L F C
          F T N S T D T V N H D S F N L Y G Y S V
            L L I V L I L L T M I L L I C M V I L S

1501    CACACCATTTGGTTCTTGTATATATTGGTCGCCGCGTCCTGGATTGTGGATTCCTATAAT    1560
        H T I W F L Y I L V A A S W I V D S Y N
          T P F G S C I Y W S P R P G L W I P I I
            H H L V L V Y I G R R V L D C G F L * L

1561    TAAATCTTCAGTCAAGTCTTATGATGATTTGGTTTATTCAGGTGTAGTAGGTTGTAAATC    1620
        * I F S Q V L * * F G L F R C S R L * I
          K S S V K S Y D D L V Y S G V V G C K S
            N L Q S S L M M I W F I Q V * * V V N L
```

FIG. 2 CONT'D

```
1621  TATTGTTAAAGAAACTGCTCTTATTACTCATGCACTTTACTTAGATTATGTTCAATGTAA  1680
       Y C * R N C S Y Y S C T L L R L C S M *
        I V K E T A L I T H A L Y L D Y V Q C K
         L L K K L L L L L M H F T * I M F N V S

1681  GTGTGGTAATCTTGAACAAAATCATATTCTTGGCGTTAATAATTCTTGGTGTAGGCAACT  1740
       V W * S * T K S Y S W R * * F L V * A T
        C G N L E Q N H I L G V N N S W C R Q L
         V V I L N K I I F L A L I I L G V G N C

1741  GTTGCTTAATAGAGGTGATTATAATATGCTTCTAAAAAATATTGACTTGTTTGTTAAGCG  1800
       V A * * R * L * Y A S K K Y * L V C * A
        L L N R G D Y N M L L K N I D L F V K R
         C L I E V I I I C F * K I L T C L L S V

1801  TCGTGCTGATTTTGCTTGCAAGTTTGCAGTTTGTGGAGATGGTTTTGTACCTTTTTTACT  1860
       S C * F C L Q V C S L W R W F C T F F T
        R A D F A C K F A V C G D G F V P F L L
         V L I L L A S L Q F V E M V L Y L F Y *

1861  AGATGGTTTAATTCCCCGTAGTTATTATCTAATTCAGAGTGGTATTTTCTTTACATCTTT  1920
       R W F N S P * L L S N S E W Y F L Y I F
        D G L I P R S Y Y L I Q S G I F F T S L
         M V * F P V V I I * F R V V F S L H L *

1921  GATGTCTCAATTTTCACAAGAAGTTTCTGATATGTGTTTAAAAATGTGTATTTTGTTTAT  1980
       D V S I F T R S F * Y V F K N V Y F V Y
        M S Q F S Q E V S D M C L K M C I L F M
         C L N F H K K F L I C V * K C V F C L W

1981  GGACAGAGTTTCAGTTGCTACATTTTATATAGAGCATTATGTTAATAGGTTGGTTACTCA  2040
       G Q S F S C Y I L Y R A L C * * V G Y S
        D R V S V A T F Y I E H Y V N R L V T Q
         T E F Q L L H F I * S I M L I G W L L N

2041  ATTTAAGTTATTGGGTACTACACTTGTTAATAAAATGGTTAATTGGTTTAATACCATGTT  2100
       I * V I G Y Y T C * * N G * L V * Y H V
        F K L L G T T L V N K M V N W F N T M L
         L S Y W V L H L L I K W L I G L I P C *

2101  AGATGCTAGTGCACCTGCTACAGGCTGGCTTCTTTACCAATTATTGAATGGTCTTTTTGT  2160
       R C * C T C Y R L A S L P I I E W S F C
        D A S A P A T G W L L Y Q L L N G L F V
         M L V H L L Q A G F F T N Y * M V F L *
```

FIG. 2 CONT'D

```
2161  AGTATCTCAAGCCAACTTTAATTTTGTTGCTTTAATACCTGATTATGCTAAAATTTTAGT    2220
       S  I  S  S  Q  L  *  F  C  C  F  N  T  *  L  C  *  N  F  S
        V  S  Q  A  N  F  N  F  V  A  L  I  P  D  Y  A  K  I  L  V
         Y  L  K  P  T  L  I  L  L  L  *  Y  L  I  M  L  K  F  *  L

2221  TAATAAATTTTACACTTTTTTTAAGTTATTATTAGAGTGTGTTACAGTTGATGTTTTAAA    2280
       *  *  I  L  H  F  F  *  V  I  I  R  V  C  Y  S  *  C  F  K
        N  K  F  Y  T  F  F  K  L  L  L  E  C  V  T  V  D  V  L  K
         I  N  F  T  L  F  L  S  Y  Y  *  S  V  L  Q  L  M  F  *  K

2281  AGATATGCCTGTTCTTAAAACTATTAATGGTTTAGTTTGTATTGTAGGCAATAAGTTTTA    2340
       R  Y  A  C  S  *  N  Y  *  W  F  S  L  Y  C  R  Q  *  V  L
        D  M  P  V  L  K  T  I  N  G  L  V  C  I  V  G  N  K  F  Y
         I  C  L  F  L  K  L  L  M  V  *  F  V  L  *  A  I  S  F  I

2341  TAACGTTAGTACAGGGTTAATTCCTGGTTTTGTTTTACCATGTAATGCACAGGAACAACA    2400
       *  R  *  Y  R  V  N  S  W  F  C  F  T  M  *  C  T  G  T  T
        N  V  S  T  G  L  I  P  G  F  V  L  P  C  N  A  Q  E  Q  Q
         T  L  V  Q  G  *  F  L  V  L  F  Y  H  V  M  H  R  N  N  K

2401  AATTTATTTTTTTGAAGGCGTTGCAGAATCTGTTATAGTAGAAGATGATGTTATTGAGAA    2460
       N  L  F  F  *  R  R  C  R  I  C  Y  S  R  R  *  C  Y  *  E
        I  Y  F  F  E  G  V  A  E  S  V  I  V  E  D  D  V  I  E  N
         F  I  F  L  K  A  L  Q  N  L  L  *  *  K  M  M  L  L  R  M

2461  TGTCAAATCTTCTTTATCATCTTATGAGTATTGTCAACCACCTAAATCTGTAGAAAAAAT    2520
       C  Q  I  F  F  I  I  L  *  V  L  S  T  T  *  I  C  R  K  N
        V  K  S  S  L  S  S  Y  E  Y  C  Q  P  P  K  S  V  E  K  I
         S  N  L  L  Y  H  L  M  S  I  V  N  H  L  N  L  *  K  K  F

2521  TTGTATTATAGATAATATGTACATGGGTAAGTGTGGTGATAAATTTTTCCCTATTGTCAT    2580
       L  Y  Y  R  *  Y  V  H  G  *  V  W  *  *  I  F  P  Y  C  H
        C  I  I  D  N  M  Y  M  G  K  C  G  D  K  F  F  P  I  V  M
         V  L  *  I  I  C  T  W  V  S  V  V  I  N  F  S  L  L  S  *

2581  GAATGATAAAAATATTTGTCTTTTAGATCAGGCTTGGCGTTTTCCATGTGCAGGTAGAAA    2640
       E  *  *  K  Y  L  S  F  R  S  G  L  A  F  S  M  C  R  *  K
        N  D  K  N  I  C  L  L  D  Q  A  W  R  F  P  C  A  G  R  K
         M  I  K  I  F  V  F  *  I  R  L  G  V  F  H  V  Q  V  E  K

2641  AGTTAATTTTAACGAGAAACCTGTTGTTATGGAGATTCCGTCTTTGATGACAGTTAAGGT    2700
       S  *  F  *  R  E  T  C  C  Y  G  D  S  V  F  D  D  S  *  G
        V  N  F  N  E  K  P  V  V  M  E  I  P  S  L  M  T  V  K  V
         L  I  L  T  R  N  L  L  L  W  R  F  R  L  *  *  Q  L  R  L
```

FIG. 2 CONT'D

```
2701  TATGTTTGATTTAGATTCTACTTTTGATGATATTTTAGGTAAAGTTTGTTCAGAATTTGA  2760
       Y  V  *  F  R  F  Y  F  *  *  Y  F  R  *  S  L  F  R  I  *
        M  F  D  L  D  S  T  F  D  D  I  L  G  K  V  C  S  E  F  E
         C  L  I  *  I  L  L  L  M  I  F  *  V  K  F  V  Q  N  L  K

2761  AGTAGAAAAGGGTGTTACTGTAGATGATTTTGTTGCTGTTGTTTGTGATGCTATAGAGAA  2820
       S  R  K  G  C  Y  C  R  *  F  C  C  C  C  L  *  C  Y  R  E
        V  E  K  G  V  T  V  D  D  F  V  A  V  V  C  D  A  I  E  N
         *  K  R  V  L  L  *  M  I  L  L  L  L  F  V  M  L  *  R  M

2821  TGCTTTAAACTCTTGTAAAGAGCATCCAGTGGTTGGTTATCAAGTTCGTGCATTTTTAAA  2880
       C  F  K  L  L  *  R  A  S  S  G  W  L  S  S  S  C  I  F  K
        A  L  N  S  C  K  E  H  P  V  V  G  Y  Q  V  R  A  F  L  N
         L  *  T  L  V  K  S  I  Q  W  L  V  I  K  F  V  H  F  *  I

2881  TAAACTTAATGAGAATGTTGTTTATTTATTTGATGAGGCTGGTGATGAAGCAATGGCCTC  2940
       *  T  *  *  E  C  C  L  F  I  *  *  G  W  *  *  S  N  G  L
        K  L  N  E  N  V  V  Y  L  F  D  E  A  G  D  E  A  M  A  S
         N  L  M  R  M  L  F  I  Y  L  M  R  L  V  M  K  Q  W  P  L

2941  TCGTATGTATTGTACTTTTGCTATTGAGGATGTTGAAGACGTTATCAGTAGTGAAGCTGT  3000
       S  Y  V  L  Y  F  C  Y  *  G  C  *  R  R  Y  Q  *  *  S  C
        R  M  Y  C  T  F  A  I  E  D  V  E  D  V  I  S  S  E  A  V
         V  C  I  V  L  L  L  R  M  L  K  T  L  S  V  V  K  L  S

3001  CGAAGATACTATTGATGGTGTCGTTGAAGACACTATTAATGACGATGAAGATGTTGTTAC  3060
       R  R  Y  Y  *  W  C  R  *  R  H  Y  *  *  R  *  R  C  C  Y
        E  D  T  I  D  G  V  V  E  D  T  I  N  D  D  E  D  V  V  T
         K  I  L  L  M  V  S  L  K  T  L  L  M  T  M  K  M  L  L  L

3061  TGGTGACAATGACGATGAAGATGTTGTTACTGGTGACAATGACGATGAAGATGTTGTTAC  3120
       W  *  Q  *  R  *  R  C  C  Y  W  *  Q  *  R  *  R  C  C  Y
        G  D  N  D  D  E  D  V  V  T  G  D  N  D  D  E  D  V  V  T
         V  T  M  T  M  K  M  L  L  L  V  T  M  T  M  K  M  L  L  L

3121  TGGTGACAATGACGATGAAGATGTTGTTACTGGTGACAATGACGATGAAGATGTTGTTAC  3180
       W  *  Q  *  R  *  R  C  C  Y  W  *  Q  *  R  *  R  C  C  Y
        G  D  N  D  D  E  D  V  V  T  G  D  N  D  D  E  D  V  V  T
         V  T  M  T  M  K  M  L  L  L  V  T  M  T  M  K  M  L  L  L

3181  TGGTGACAATGACGATGAAGATGTTGTTACTGGTGACAATGACGATGAAGATGTTGTTAC  3240
       W  *  Q  *  R  *  R  C  C  Y  W  *  Q  *  R  *  R  C  C  Y
        G  D  N  D  D  E  D  V  V  T  G  D  N  D  D  E  D  V  V  T
         V  T  M  T  M  K  M  L  L  L  V  T  M  T  M  K  M  L  L  L
```

FIG. 2 CONT'D

```
3241   TGGTGACAATGACGATGAAGATGTTGTTACTGGTGACAATGACGATGAAGATGTTGTTAC   3300
       W * Q * R * R C C Y W * Q * R * R C C Y
         G D N D D E D V V T G D N D D E D V V T
           V T M T M K M L L L V T M T M K M L L L

3301   TGGTGACAATGACGATGAAGATGTTGTTACTGGTGACAATGACGATGAAGATGTTGTTAC   3360
       W * Q * R * R C C Y W * Q * R * R C C Y
         G D N D D E D V V T G D N D D E D V V T
           V T M T M K M L L L V T M T M K M L L L

3361   TGGTGACAATGACGATGAAGATGTTGTTACTGGTGACAATGACGATGAAGATGTTGTTAC   3420
       W * Q * R * R C C Y W * Q * R * R C C Y
         G D N D D E D V V T G D N D D E D V V T
           V T M T M K M L L L V T M T M K M L L L

3421   TGGTGACAATGACGATGAAGATGTTGTTACTGGTGACAATAACGATGAAGAGATTGTTAC   3480
       W * Q * R * R C C Y W * Q * R * R D C Y
         G D N D D E D V V T G D N N D E E I V T
           V T M T M K M L L L V T I T M K R L L

3481   TGGTGACAATGATGACCAAATTGTTGTTACTGGTGATGATGTAGATGATATTGAAAGTAT   3540
       W * Q * * P N C C Y W * * C R * Y * K Y
         G D N D D Q I V V T G D D V D D I E S I
           V T M M T K L L L V M M * M I L K V F

3541   TTATGACTTTGATACTTATAAAGCTCTTTTAGTTTTTAATGATGTCTATAATGATGCTTT   3600
       L * L * Y L * S S F S F * * C L * * C F
         Y D F D T Y K A L L V F N D V Y N D A L
           M T L I L I K L F * F L M M S I M M L C

3601   GTTTGTTAGTTATGGTTCTAGTGTTGAAACAGAAACATATTTTAAAGTTAATGGTTTATG   3660
       V C * L W F * C * N R N I F * S * W F M
         F V S Y G S S V E T E T Y F K V N G L W
           L L V M V L V L K Q K H I L K L M V Y G

3661   GTCACCTACTATTACACATACTAATTGTTGGTTGCGTTCTGTGTTACTTGTAATGCAGAA   3720
       V T Y Y Y T Y * L L V A F C V T C N A E
         S P T I T H T N C W L R S V L L V M Q K
           H L L H I L I V G C V L C Y L * C R N

3721   ATTACCTTTTAAGTTTAAGGATTTAGCTATTGAAAATATGTGGTTATCTTATAAGGTGGG   3780
       I T F * V * G F S Y * K Y V V I L * G G
         L P F K F K D L A I E N M W L S Y K V G
           Y L L S L R I * L L K I C G Y L I R W V
```

FIG. 2 CONT'D

```
3781  TTATAATCAAAGTTTTGTTGATTATTTACTGACCACTATTCCTAAAGCTATTGTTTTGCC  3840
      L  *  S  K  F  C  *  L  F  T  D  H  Y  S  *  S  Y  C  F  A
       Y  N  Q  S  F  V  D  Y  L  L  T  T  I  P  K  A  I  V  L  P
        I  I  K  V  L  L  I  I  Y  *  P  L  F  L  K  L  L  F  C  L

3841  TCAAGGTGGTTTTGTAGCTGATTTTGCTTATTGGTTTTTAAACCAGTTTGATATTAATGC  3900
      S  R  W  F  C  S  *  F  C  L  L  V  F  K  P  V  *  Y  *  C
       Q  G  G  F  V  A  D  F  A  Y  W  F  L  N  Q  F  D  I  N  A
        K  V  V  L  *  L  I  L  L  I  G  F  *  T  S  L  I  L  M  R

3901  GTATGCTAATTGGTGTTGTTTAAAATGTGGTTTTTCTTTTGATTTAAATGGTTTGGATGC  3960
      V  C  *  L  V  L  F  K  M  W  F  F  F  *  F  K  W  F  G  C
       Y  A  N  W  C  C  L  K  C  G  F  S  F  D  L  N  G  L  D  A
        M  L  I  G  V  V  *  N  V  V  F  L  L  I  *  M  V  W  M  L

3961  TTTGTTTTTTTATGGAGATATTGTGTCTCATGTTTGTAAGTGTGGACATAATATGACTCT  4020
      F  V  F  L  W  R  Y  C  V  S  C  L  *  V  W  T  *  Y  D  S
       L  F  F  Y  G  D  I  V  S  H  V  C  K  C  G  H  N  M  T  L
        C  F  F  M  E  I  L  C  L  M  F  V  S  V  D  I  I  *  L  *

4021  AATAGCAGCGGACTTACCTTGTACATTACATTTTTCATTATTTGATGACAATTTTTGTGC  4080
      N  S  S  G  L  T  L  Y  I  T  F  F  I  I  *  *  Q  F  L  C
       I  A  A  D  L  P  C  T  L  H  F  S  L  F  D  D  N  F  C  A
        *  Q  R  T  Y  L  V  H  Y  I  F  H  Y  L  M  T  I  F  V  L

4081  TTTTTGCACCCCTAAAAAAATTTTTATTGCTGCATGTGCTGTGGATGTAAACGTTTGTCA  4140
      F  L  H  P  *  K  N  F  Y  C  C  M  C  C  G  C  K  R  L  S
       F  C  T  P  K  K  I  F  I  A  A  C  A  V  D  V  N  V  C  H
        F  A  P  L  K  K  F  L  L  L  H  V  L  W  M  *  T  F  V  I

4141  TTCTGTAGCTGTTATAGGTGATGAACAAATAGATGGTAAGTTTGTTACTAAATTTAGTGG  4200
      F  C  S  C  Y  R  *  *  T  N  R  W  *  V  C  Y  *  I  *  W
       S  V  A  V  I  G  D  E  Q  I  D  G  K  F  V  T  K  F  S  G
        L  *  L  L  *  V  M  N  K  *  M  V  S  L  L  N  L  V  V

4201  TGATAAATTTGATTTATAGTAGGTTATGGAATGTCATTTAGTATGTCTTCTTTTGAGTT  4260
      *  *  I  *  F  Y  S  R  L  W  N  V  I  *  Y  V  F  F  *  V
       D  K  F  D  F  I  V  G  Y  G  M  S  F  S  M  S  S  F  E  L
        I  N  L  I  L  *  *  V  M  E  C  H  L  V  C  L  L  S  Y

4261  ACCTCAATTGTATGGTTTGTGTATAACACCTAATGTATGTTTTGTTAAAGGTGATATTAT  4320
      T  S  I  V  W  F  V  Y  N  T  *  C  M  F  C  *  R  *  Y  Y
       P  Q  L  Y  G  L  C  I  T  P  N  V  C  F  V  K  G  D  I  I
        L  N  C  M  V  C  V  *  H  L  M  Y  V  L  L  K  V  I  L  *
```

FIG. 2 CONT'D

```
4321    AAATGTTGCTAGACTTGTTAAAGCTGATGTTATTGTTAATCCTGCTAATGGGCATATGCT    4380
         K  C  C  *  T  C  *  S  *  C  Y  C  *  S  C  *  W  A  Y  A
          N  V  A  R  L  V  K  A  D  V  I  V  N  P  A  N  G  H  M  L
           M  L  L  D  L  L  K  L  M  L  L  L  I  L  L  M  G  I  C  S

4381    CCATGGTGGTGGAGTTGCAAAAGCTATAGCTGTAGCTGCAGGTAAAAAATTTTCTAAAGA    4440
         P  W  W  W  S  C  K  S  Y  S  C  S  C  R  *  K  I  F  *  R
          H  G  G  G  V  A  K  A  I  A  V  A  A  G  K  K  F  S  K  E
           M  V  V  E  L  Q  K  L  *  L  *  L  Q  V  K  N  F  L  K  K

4441    AACTGCTGCTATGGTTAAATCTAAAGGTGTTTGCCAAGTAGGAGATTGTTATGTTTCTAC    4500
         N  C  C  Y  G  *  I  *  R  C  L  P  S  R  R  L  L  C  F  Y
          T  A  A  M  V  K  S  K  G  V  C  Q  V  G  D  C  Y  V  S  T
           L  L  L  W  L  N  L  K  V  F  A  K  *  E  I  V  M  F  L  P

4501    CGGTGGTAAATTATGTAAAACAATTCTTAATATTGTAGGCCCTGATGCTAGACAAGATGG    4560
         R  W  *  I  M  *  N  N  S  *  Y  C  R  P  *  C  *  T  R  W
          G  G  K  L  C  K  T  I  L  N  I  V  G  P  D  A  R  Q  D  G
           V  V  N  Y  V  K  Q  F  L  I  L  *  A  L  M  D  K  M  E

4561    AAGACAATCTTATGTTTTGTTAGCACGTGCTTATAAGCATCTTAATAATTATGATTGTTG    4620
         K  T  I  L  C  F  V  S  T  C  L  *  A  S  *  *  L  *  L  L
          R  Q  S  Y  V  L  L  A  R  A  Y  K  H  L  N  N  Y  D  C  C
           D  N  L  M  F  C  *  H  V  L  I  S  I  L  I  I  M  I  V  V

4621    TTTGTCTACTCTCATATCGGCTGGTATATTTAGTGTTCCTGCTGATGTGTCATTAACTTA    4680
         F  V  Y  S  H  I  G  W  Y  I  *  C  S  C  *  C  V  I  N  L
          L  S  T  L  I  S  A  G  I  F  S  V  P  A  D  V  S  L  T  Y
           C  L  L  S  Y  R  L  V  Y  L  V  F  L  L  M  C  H  *  L  T

4681    CCTTCTAGGTGTTGTTGATAAACAAGTTATCCTTGTTAGTAATAATAAAGAAGATTTTGA    4740
         P  S  R  C  C  *  *  T  S  Y  P  C  *  *  *  R  R  F  *
          L  L  G  V  V  D  K  Q  V  I  L  V  S  N  N  K  E  D  F  D
           F  *  V  L  L  I  N  K  L  S  L  L  V  I  I  K  K  I  L  I

4741    TATTATTCAAAAATGTCAAATTACTTCAGTTGTTGGTACTAAAGCATTGGCTGTTAGATT    4800
         Y  Y  S  K  M  S  N  Y  F  S  C  W  Y  *  S  I  G  C  *  I
          I  I  Q  K  C  Q  I  T  S  V  V  G  T  K  A  L  A  V  R  L
           L  F  K  N  V  K  L  L  Q  L  L  V  L  K  H  W  L  L  D  *

4801    AACTGCTAATGTAGGCCGTGTTATTAAATTTGAGACAGATGCATACAAACTTTTTTTGAG    4860
         N  C  *  C  R  P  C  Y  *  I  *  D  R  C  I  Q  T  F  F  E
          T  A  N  V  G  R  V  I  K  F  E  T  D  A  Y  K  L  F  L  S
           L  L  M  *  A  V  L  L  N  L  R  Q  M  H  T  N  F  F  *  V
```

FIG. 2 CONT'D

```
4861    TGGTGATGATTGTTTTGTTTCAAATTCTTCTGTTATACAAGAAGTTTTATTGCTTCGTCA    4920
         W  *  *  L  F  C  F  K  F  F  C  Y  T  R  S  F  I  A  S  S
          G  D  D  C  F  V  S  N  S  S  V  I  Q  E  V  L  L  L  R  H
           V  M  I  V  L  F  Q  I  L  L  L  Y  K  K  F  Y  C  F  V  M

4921    TGATATACAATTGAATAATGACGTTCGTGATTATTTGTTGTCTAAGATGACTAGTCTTCC    4980
         *  Y  T  I  E  *  *  R  S  *  L  F  V  V  *  D  D  *  S  S
          D  I  Q  L  N  N  D  V  R  D  Y  L  L  S  K  M  T  S  L  P
           I  Y  N  *  I  M  T  F  V  I  I  C  C  L  R  *  L  V  F  L

4981    TAAAGATTGGCGTCTTATCAATAAATTTGATGTTATTAACGGTGTTAAAACTGTTAAGTA    5040
         *  R  L  A  S  Y  Q  *  I  *  C  Y  *  R  C  *  N  C  *  V
          K  D  W  R  L  I  N  K  F  D  V  I  N  G  V  K  T  V  K  Y
           K  I  G  V  L  S  I  N  L  M  L  L  T  V  L  K  L  L  S  I

5041    TTTTGAGTGTCCTAATTCTATTTATATATGTAGTCAGGGTAAAGACTTTGGTTATGTATG    5100
         F  *  V  S  *  F  Y  L  Y  M  *  S  G  *  R  L  W  L  C  M
          F  E  C  P  N  S  I  Y  I  C  S  Q  G  K  D  F  G  Y  V  C
           L  S  V  L  I  L  F  I  Y  V  V  R  V  K  T  L  V  M  Y  V

5101    TGATGGTTCTTTTTATAAAGCAACTGTTAATCAAGTTTGTGTTTTATTAGCTAAGAAGAT    5160
         *  W  F  F  L  *  S  N  C  *  S  S  L  C  F  I  S  *  E  D
          D  G  S  F  Y  K  A  T  V  N  Q  V  C  V  L  L  A  K  K  I
           M  V  L  F  I  K  Q  L  L  I  K  F  V  F  Y  *  L  R  R  *

5161    AGATGTTTTGCTTACTGTAGATGGTGTTAATTTTAAATCTATTTCTCTTACTGTAGGTGA    5220
         R  C  F  A  Y  C  R  W  C  *  F  *  I  Y  F  S  Y  C  R  *
          D  V  L  L  T  V  D  G  V  N  F  K  S  I  S  L  T  V  G  E
           M  F  C  L  L  *  M  V  L  I  L  N  L  F  L  L  L  *  V  K

5221    AGTTTTTGGTAAAATACTTGGTAATGTTTTCTGTGATGGCATTGATGTTACTAAGTTAAA    5280
         S  F  W  *  N  T  W  *  C  F  L  *  W  H  *  C  Y  *  V  K
          V  F  G  K  I  L  G  N  V  F  C  D  G  I  D  V  T  K  L  K
           F  L  V  K  Y  L  V  M  F  S  V  M  A  L  M  L  L  S  *  S

5281    GTGTAGTGATTTTTATGCCGATAAAATTTTATATCAGTATGAAAATTTGTCTTTAGCTGA    5340
         V  *  *  F  L  C  R  *  N  F  I  S  V  *  K  F  V  F  S  *
          C  S  D  F  Y  A  D  K  I  L  Y  Q  Y  E  N  L  S  L  A  D
           V  V  I  F  M  P  I  K  F  Y  I  S  M  K  I  C  L  *  L  I

5341    TATTTCTGCTGTACAAAGTTCATTTGGGTTTGATCAGCAACAATTGCTTGCTTATTATAA    5400
         Y  F  C  C  T  K  F  I  W  V  *  S  A  T  I  A  C  L  L  *
          I  S  A  V  Q  S  S  F  G  F  D  Q  Q  Q  L  L  A  Y  Y  N
           F  L  L  Y  K  V  H  L  G  L  I  S  N  N  C  L  L  I  I  I
```

FIG. 2 CONT'D

```
5401    TTTTTTAACAGTATGTAAATGGTCTGTAGTTGTTAACGGTCCATTTTTTTCTTTTGAACA    5460
         F  F  N  S  M  *  M  V  C  S  C  *  R  S  I  F  F  F  *  T
          F  L  T  V  C  K  W  S  V  V  V  N  G  P  F  F  S  F  E  Q
           F  *  Q  Y  V  N  G  L  *  L  L  T  V  H  F  F  L  L  N  S

5461    GTCTCATAATAATTGTTATGTGAATGTAGCTTGTCTTATGTTGCAGCATATTAATCTTAA    5520
         V  S  *  *  L  L  C  E  C  S  L  S  Y  V  A  A  Y  *  S  *
          S  H  N  N  C  Y  V  N  V  A  C  L  M  L  Q  H  I  N  L  K
           L  I  I  I  V  M  *  M  *  L  V  L  C  C  S  I  L  I  L  N

5521    ATTTAATAAATGGCAGTGGCAGGAAGCATGGTATGAATTTCGTGCTGGCAGACCACATAG    5580
         I  *  *  M  A  V  A  G  S  M  V  *  I  S  C  W  Q  T  T  *
          F  N  K  W  Q  W  Q  E  A  W  Y  E  F  R  A  G  R  P  H  R
           L  I  N  G  S  G  R  K  H  G  M  N  F  V  L  A  D  H  I  G

5581    GTTAGTTGCTCTTGTTTTAGCTAAAGGTCATTTTAAATTTGATGAACCATCAGATGCTAC    5640
         V  S  C  S  C  F  S  *  R  S  F  *  I  *  *  T  I  R  C  Y
          L  V  A  L  V  L  A  K  G  H  F  K  F  D  E  P  S  D  A  T
           *  L  L  L  F  *  L  K  V  I  L  N  L  M  N  H  Q  M  L  L

5641    TGATTTTATTCGTGTTGTTTTGAAACAAGCTGATTTATCAGGTGCAATTTGTGAATTAGA    5700
         *  F  Y  S  C  C  F  E  T  S  *  F  I  R  C  N  L  *  I  R
          D  F  I  R  V  V  L  K  Q  A  D  L  S  G  A  I  C  E  L  E
           I  L  F  V  L  F  *  N  K  L  I  Y  Q  V  Q  F  V  N  *  N

5701    ACTTATTTGTGATTGTGGTATTAAACAAGAAAGTCGTGTTGGTGTTGATGCTGTTATGCA    5760
         T  Y  L  *  L  W  Y  *  T  R  K  S  C  W  C  *  C  C  Y  A
          L  I  C  D  C  G  I  K  Q  E  S  R  V  G  V  D  A  V  M  H
           L  F  V  I  V  V  L  N  K  K  V  V  L  V  L  M  L  L  C  I

5761    TTTTGGTACATTAGCAAAGACTGATCTTTTTAATGGTTATAAGATTGGCTGTAATTGTGC    5820
         F  W  Y  I  S  K  D  *  S  F  *  W  L  *  D  W  L  *  L  C
          F  G  T  L  A  K  T  D  L  F  N  G  Y  K  I  G  C  N  C  A
           L  V  H  *  Q  R  L  I  F  L  M  V  I  R  L  A  V  I  V  Q

5821    AGGTAGAATTGTCCATTGTACTAAATTGAATGTACCATTTTTGATTTGTTCTAATACTCC    5880
         R  *  N  C  P  L  Y  *  I  E  C  T  I  F  D  L  F  *  Y  S
          G  R  I  V  H  C  T  K  L  N  V  P  F  L  I  C  S  N  T  P
           V  E  L  S  I  V  L  N  *  M  Y  H  F  *  F  V  L  I  L  L

5881    TCTGAGTAAGGATTTACCTGATGATGTTGTTGCAGCTAACATGTTTATGGGTGTAGGTGT    5940
         S  E  *  G  F  T  *  *  C  C  C  S  *  H  V  Y  G  C  R  C
          L  S  K  D  L  P  D  D  V  V  A  A  N  M  F  M  G  V  G  V
           *  V  R  I  Y  L  M  M  L  L  Q  L  T  C  L  W  V  *  V  *
```

FIG. 2 CONT'D

```
5941  AGGCCATTATACACATTTGAAATGTGGTTCACCTTACCAACATTATGATGCTTGTAGTGT  6000
      R  P  L  Y  T  F  E  M  W  F  T  L  P  T  L  *  C  L  *  C
       G  H  Y  T  H  L  K  C  G  S  P  Y  Q  H  Y  D  A  C  S  V
        A  I  I  H  I  *  N  V  V  H  L  T  N  I  M  M  L  V  V  L

6001  TAAAAAATATACAGGTGTTAGTGGTTGTTTAACTGACTGCTTGTATCTTAAAAATTTAAC  6060
      *  K  I  Y  R  C  *  W  L  F  N  *  L  L  V  S  *  K  F  N
       K  K  Y  T  G  V  S  G  C  L  T  D  C  L  Y  L  K  N  L  T
        K  N  I  Q  V  L  V  V  V  *  L  T  A  C  I  L  K  I  *  P

6061  CCAGACTTTTACATCTATGTTGACTAATTATTTTTGGATGATGTTGAAATGGTTGCTTA  6120
      P  D  F  Y  I  Y  V  D  *  L  F  F  G  *  C  *  N  G  C  L
       Q  T  F  T  S  M  L  T  N  Y  F  L  D  D  V  E  M  V  A  Y
        R  L  L  H  L  C  *  L  I  I  F  W  M  M  L  K  W  L  L  I

6121  TAACCCTGATCTTTCACAATATTATTGTGATAATGGTAAGTATTATACAAAACCTATTAT  6180
      *  P  *  S  F  T  I  L  L  *  *  W  *  V  L  Y  K  T  Y  Y
       N  P  D  L  S  Q  Y  Y  C  D  N  G  K  Y  Y  T  K  P  I  I
        T  L  I  F  H  N  I  I  V  I  M  V  S  I  I  Q  N  L  L  *

6181  AAAGGCTCAGTTTAAACCATTTGCTAAAGTTGACGGTGTTTATACTAACTTTAAGTTAGT  6240
      K  G  S  V  *  T  I  C  *  S  *  R  C  L  Y  *  L  *  V  S
       K  A  Q  F  K  P  F  A  K  V  D  G  V  Y  T  N  F  K  L  V
        R  L  S  L  N  H  L  L  K  L  T  V  F  I  L  T  L  S  *  L

6241  TGGACATGATATTTGTGCTCAATTGAATGATAAGTTAGGTTTTAATGTAGATTTGCCGTT  6300
      W  T  *  Y  L  C  S  I  E  *  *  V  R  F  *  C  R  F  A  V
       G  H  D  I  C  A  Q  L  N  D  K  L  G  F  N  V  D  L  P  F
        D  M  I  F  V  L  N  *  M  I  S  *  V  L  M  *  I  C  R  L

6301  TGTTGAGTACAAAGTAACAGTCTGGCCTGTAGCTACTGGTGATGTTGTTTTGGCATCTGA  6360
      C  *  V  Q  S  N  S  L  A  C  S  Y  W  *  C  C  F  G  I  *
       V  E  Y  K  V  T  V  W  P  V  A  T  G  D  V  V  L  A  S  D
        L  S  T  K  *  Q  S  G  L  *  L  L  V  M  L  F  W  H  L  M

6361  TGATTTATATGTGAAACGTTATTTTAAAGGATGTGAAACTTTTGGTAAGCCTGTTATTTG  6420
      *  F  I  C  E  T  L  F  *  R  M  *  N  F  W  *  A  C  Y  L
       D  L  Y  V  K  R  Y  F  K  G  C  E  T  F  G  K  P  V  I  W
        I  Y  M  *  N  V  I  L  K  D  V  K  L  L  V  S  L  L  F  G

6421  GTTTTGTCATGATGAAGCATCATTGAATTCTCTTACTTATTTTAATAAACCTAGTTTTAA  6480
      V  L  S  *  *  S  I  I  E  F  S  Y  L  F  *  *  T  *  F  *
       F  C  H  D  E  A  S  L  N  S  L  T  Y  F  N  K  P  S  F  K
        F  V  M  M  K  H  H  *  I  L  L  L  I  L  I  N  L  V  L  N
```

FIG. 2 CONT'D

```
6481   ATCTGAAAATAGATATAGTGTTTTGTCTGTTGATTCTGTATCTGAGGAGTCACAAGGTAA   6540
        I * K * I * C F V C * F C I * G V T R *
         S E N R Y S V L S V D S V S E E S Q G N
          L K I D I V F C L L I L Y L R S H K V M

6541   TGTGGTTACTTCTGTTATGGAATCGCAGATTAGTACTAAAGAGGTTAAGTTAAAGGGTGT   6600
        C G Y F C Y G I A D * Y * R G * V K G C
         V V T S V M E S Q I S T K E V L K G V
          W L L L W N R R L V L K R L S * R V L

6601   TAGAAAGACTGTTAAAATAGAAGATGCTATTATTGTTAATGATGAAAATAGTTCTATTAA   6660
        * K D C * N R R C Y Y C * * * K * F Y *
         R K T V K I E D A I I V N D E N S S I K
          E R L L K * K M L L L M M K I V L L R

6661   GGTTGTTAAAAGTTTATCTTTAGTTGATGTTTGGGATATGTATTTGACAGGTTGTGATTA   6720
        G C * K F I F S * C L G Y V F D R L * L
         V V K S L S L V D V W D M Y L T G C D Y
          L L K V Y L * L M F G I C I * Q V V I M

6721   TGTTGTTTGGGTTGCTAATGAATTGTCACGCCTAGTTAAATCACCAACAGTTAGGGAATA   6780
        C C L G C * * I V T P S * I T N S * G I
         V V W V A N E L S R L V K S P T V R E Y
          L F G L L M N C H A * L N H Q Q L G N I

6781   TATACGATATGGTATTAAACCTATTACTATACCTATAGATTTGTTATGTTTAAGAGATGA   6840
        Y T I W Y * T Y Y Y T Y R F V M F K R *
         I R Y G I K P I T I P I D L L C L R D D
          Y D M V L N L L L Y L * I C Y V * E M I

6841   TAATCAAACTCTTTTAGTTCCTAAAATTTTTAAAGCAAGAGCTATAGAATTTTATGGTTT   6900
        * S N S F S S * N F * S K S Y R I L W F
         N Q T L L V P K I F K A R A I E F Y G F
          I K L F * F L K F L K Q E L * N F M V F

6901   TTTGAAGTGGTTGTTTATTTATGTTTTTAGTTTATTACATTTTACAAATGATAAAACCAT   6960
        F E V V V Y L C F * F I T F Y K * * N H
         L K W L F I Y V F S L L H F T N D K T I
          * S G C L F M F L V Y Y I L Q M I K P F

6961   TTTTTATACTACAGAAATAGCTTCTAAGTTTACTTTTAATTTGTTTTGTTTGGCTCTTAA   7020
        F L Y Y R N S F * V Y F * F V L F G S *
         F Y T T E I A S K F T F N L F C L A L K
          F I L Q K * L L S L L L I C F V W L L K
```

FIG. 2 CONT'D

| | | |
|---|---|---|
| 7021 | AAATGCTTTTCAGACATTTAGATGGAGTATATTTATAAAAGGTTTTCTTGTTGTAGCCAC | 7080 |
| | K C F S D I * M E Y I Y K R F S C C S H | |
| | N A F Q T F R W S I F I K G F L V V A T | |
| | M L F R H L D G V Y L * K V F L L * P L | |
| 7081 | TGTGTTTTGTTTTGGTTTAATTTTTTGTATATAAATGTTATTTTTAGTGACTTTTATCT | 7140 |
| | C V F V L V * F F V Y K C Y F * * L L S | |
| | V F L F W F N F L Y I N V I F S D F Y L | |
| | C F C F G L I F C I * M L F L V T F I F | |
| 7141 | TCCTAATATTAGTGTTTTTCCTATTTTTGTGGGAAGAATTGTTATGTGGATAAAGGCTAC | 7200 |
| | S * Y * C F S Y F C G K N C Y V D K G Y | |
| | P N I S V F P I F V G R I V M W I K A T | |
| | L I L V F F L F L W E E L L C G * R L L | |
| 7201 | TTTTGGTTTGGTTACAATTTGTGATTTTTATTCTAAGTTAGGTGTAGGTTTTACAAGTCA | 7260 |
| | F W F G Y N L * F L F * V R C R F Y K S | |
| | F G L V T I C D F Y S K L G V G F T S H | |
| | L V W L Q F V I F I L S * V * V L Q V I | |
| 7261 | TTTTTGTAATGGTAGTTTTATATGTGAATTGTGTCATTCTGGTTTTGATATGTTGGATAC | 7320 |
| | F L * W * F Y M * I V S F W F * Y V G Y | |
| | F C N G S F I C E L C H S G F D M L D T | |
| | F V M V V L Y V N C V I L V L I C W I H | |
| 7321 | ATATGCAGCTATAGATTTTGTTCAGTATGAAGTAGATAGACGTGTTTTATTTGATTATGT | 7380 |
| | I C S Y R F C S V * S R * T C F I * L C | |
| | Y A A I D F V Q Y E V D R R V L F D Y V | |
| | M Q L * I L F S M K * I D V F Y L I M L | |
| 7381 | TAGTTTAGTCAAATTAATTGTTGAACTCGTTATTGGTTATTCATTATACACAGTATGGTT | 7440 |
| | * F S Q I N C * T R Y W L F I I H S M V | |
| | S L V K L I V E L V I G Y S L Y T V W F | |
| | V * S N * L L N S L L V I H Y T Q Y G F | |
| 7441 | TTATCCATTATTTTGTCTTATTGGTTTACAATTATTTACTACATGGTTGCCTGATTTGTT | 7500 |
| | L S I I L S Y W F T I I Y Y M V A * F V | |
| | Y P L F C L I G L Q L F T T W L P D L F | |
| | I H Y F V L L V Y N Y L L H G C L I C L | |
| 7501 | TATGTTAGAAACTATGCATTGGTTGATTAGATTTATTGTATTTGTAGCTAATATGTTACC | 7560 |
| | Y V R N Y A L V D * I Y C I C S * Y V T | |
| | M L E T M H W L I R F I V F V A N M L P | |
| | C * K L C I G * L D L L Y L * L I C Y L | |

FIG. 2 CONT'D

```
7561  TGCTTTTGTCTTGTTGCGGTTTTATATAGTTGTTACTGCTATGTATAAAGTAGTTGGTTT  7620
       C  F  C  L  V  A  V  L  Y  S  C  Y  C  Y  V  *  S  S  W  F
        A  F  V  L  L  R  F  Y  I  V  V  T  A  M  Y  K  V  V  G  F
         L  L  S  C  C  G  F  I  *  L  L  L  C  I  K  *  L  V  L

7621  TATTAGGCATATTGTCTATGGTTGTAATAAAGCTGGTTGTTTATTTTGTTATAAACGAAA  7680
       Y  *  A  Y  C  L  W  L  *  *  S  W  L  F  I  L  L  *  T  K
        I  R  H  I  V  Y  G  C  N  K  A  G  C  L  F  C  Y  K  R  N
         L  G  I  L  S  M  V  V  I  K  L  V  V  Y  F  V  I  N  E  I

7681  TTGTAGTGTTCGTGTTAAGTGTAGTACTATTGTTGGTGGTGTAATTCGTTATTATGATAT  7740
       L  *  C  S  C  *  V  *  Y  Y  C  W  W  C  N  S  L  L  *  Y
        C  S  V  R  V  K  C  S  T  I  V  G  G  V  I  R  Y  Y  D  I
         V  V  F  V  L  S  V  V  L  L  L  V  V  *  F  V  I  M  I  L

7741  TACTGCTAATGGTGGTACTGGTTTTTGTGTTAAACATCAATGGAATTGTTTTAATTGCCA  7800
       Y  C  *  W  W  Y  W  F  L  C  *  T  S  M  E  L  F  *  L  P
        T  A  N  G  G  T  G  F  C  V  K  H  Q  W  N  C  F  N  C  H
         L  L  M  V  V  L  V  F  V  L  N  I  N  G  I  V  L  I  A  I

7801  TTCTTTTAAACCAGGTAACACTTTTATAACTGTAGAAGCTGCTATAGAACTTTCTAAAGA  7860
       F  F  *  T  R  *  H  F  Y  N  C  R  S  C  Y  R  T  F  *  R
        S  F  K  P  G  N  T  F  I  T  V  E  A  A  I  E  L  S  K  E
         L  L  N  Q  V  T  L  L  *  L  *  K  L  L  *  N  F  L  K  S

7861  GCTTAAACGACCTGTAAATCCAACTGATGCTTCACATTATGTAGTTACTGATATTAAGCA  7920
       A  *  T  T  C  K  S  N  *  C  F  T  L  C  S  Y  *  Y  *  A
        L  K  R  P  V  N  P  T  D  A  S  H  Y  V  V  T  D  I  K  Q
         L  N  D  L  *  I  Q  L  M  L  H  I  M  *  L  L  I  L  S  K

7921  AGTTGGTTGTATGATGCGTTTGTTCTATGATAGAGATGGACAGCGTGTTTACGATGATGT  7980
       S  W  L  Y  D  A  F  V  L  *  *  R  W  T  A  C  L  R  *  C
        V  G  C  M  M  R  L  F  Y  D  R  D  G  Q  R  V  Y  D  D  V
         L  V  V  *  C  V  C  S  M  I  E  M  D  S  V  F  T  M  M  L

7981  TGATGCTAGTTTATTTGTAGATATTAATAATCTGTTACATTCTAAAGTTAAAGTTGTTCC  8040
       *  C  *  F  I  C  R  Y  *  *  S  V  T  F  *  S  *  S  C  S
        D  A  S  L  F  V  D  I  N  N  L  L  H  S  K  V  K  V  V  P
         M  L  V  Y  L  *  I  L  I  I  C  Y  I  L  K  L  K  L  F  L

8041  TAATTTGTATGTAGTTGTAGTAGAGAGTGATGCTGATAGAGCTAATTTTCTGAATGCTGT  8100
       *  F  V  C  S  C  S  R  E  *  C  *  *  S  *  F  S  E  C  C
        N  L  Y  V  V  V  V  E  S  D  A  D  R  A  N  F  L  N  A  V
         I  C  M  *  L  *  *  R  V  M  L  I  E  L  I  F  *  M  L  L
```

FIG. 2 CONT'D

| | | |
|---|---|---|
| 8101 | TGTGTTTTATGCACAATCATTGTATAGGCCTATATTACTTGTAGACAAAAAGTTAATTAC | 8160 |
| | C V L C T I I V * A Y I T C R Q K V N Y | |
| | V F Y A Q S L Y R P I L L V D K K L I T | |
| | C F M H N H C I G L Y Y L * T K S * L L | |
| | | |
| 8161 | TACAGCTTGTAATGGTATCTCTGTAACCCAGACTATGTTTGATGTTTATGTTGATACTTT | 8220 |
| | Y S L * W Y L C N P D Y V * C L C * Y F | |
| | T A C N G I S V T Q T M F D V Y V D T F | |
| | Q L V M V S L * P R L C L M F M L I L L | |
| | | |
| 8221 | TATGTCTCATTTTGATGTTGATAGAAAGAGTTTTAATAATTTTGTTAACATTGCTCATGC | 8280 |
| | Y V S F * C * * K E F * * F C * H C S C | |
| | M S H F D V D R K S F N N F V N I A H A | |
| | C L I L M L I E R V L I I L L T L L M L | |
| | | |
| 8281 | TTCTCTTAGAGAGGGTGTGCAATTAGAAAAGGTTTTAGATACTTTTGTGGGATGTGTACG | 8340 |
| | F S * R G C A I R K G F R Y F C G M C T | |
| | S L R E G V Q L E K V L D T F V G C V R | |
| | L L E R V C N * K R F * I L L W D V Y V | |
| | | |
| 8341 | TAAATGTTGTTCCATTGATTCAGATGTTGAAACAAGATTTATTACTAAATCTATGATATC | 8400 |
| | * M L F H * F R C * N K I Y Y * I Y D I | |
| | K C C S I D S D V E T R F I T K S M I S | |
| | N V V P L I Q M L K Q D L L L N L * Y L | |
| | | |
| 8401 | TGCAGTAGCTGCTGGTTTGGAATTTACTGATGAAAATTATAACAATTTGGTACCTACATA | 8460 |
| | C S S C W F G I Y * * K L * Q F G T Y I | |
| | A V A A G L E F T D E N Y N N L V P T Y | |
| | Q * L L V W N L L M K I I T I W Y L H I | |
| | | |
| 8461 | TTTAAAGAGTGATAATATTGTAGCTGCTGATTTAGGTGTTCTTATACAGAATGGTGCTAA | 8520 |
| | F K E * * Y C S C * F R C S Y T E W C * | |
| | L K S D N I V A A D L G V L I Q N G A K | |
| | * R V I I L * L L I * V F L Y R M V L S | |
| | | |
| 8521 | GCATGTACAGGGTAATGTTGCTAAGGCAGCTAATATTTCTTGTATATGGTTTATTGATGC | 8580 |
| | A C T G * C C * G S * Y F L Y M V Y * C | |
| | H V Q G N V A K A A N I S C I W F I D A | |
| | M Y R V M L L R Q L I F L V Y G L L M L | |
| | | |
| 8581 | TTTTAATCAACTTACTGCTGATTTACAGCATAAATTAAAAAAAGCATGTGTTAAAACTGG | 8640 |
| | F * S T Y C * F T A * I K K S M C * N W | |
| | F N Q L T A D L Q H K L K K A C V K T G | |
| | L I N L L L I Y S I N * K K H V L K L A | |

FIG. 2 CONT'D

```
8641  CTTGAAGTTAAAATTGACTTTTAATAAGCAAGAGGCAAGTGTCCCTATTCTTACAACACC  8700
       L  E  V  K  I  D  F  *  *  A  R  G  K  C  P  Y  S  Y  N  T
        L  K  L  K  L  T  F  N  K  Q  E  A  S  V  P  I  L  T  T  P
         *  S  *  N  *  L  L  I  S  K  R  Q  V  S  L  F  L  Q  H  P

8701  CTTTTCACTTAAAGGAGGTGTTGTATTGAGTAATTTGTTATATATATTATTTTTTGTTAG  8760
       L  F  T  *  R  R  C  C  I  E  *  F  V  I  Y  I  I  F  C  *
        F  S  L  K  G  G  V  V  L  S  N  L  L  Y  I  L  F  F  V  S
         F  H  L  K  E  V  L  Y  *  V  I  C  Y  I  Y  Y  F  L  L  V

8761  TTTAATCTGTTTTATATTATTGTGGGCTTTATTGCCTACATATAGTGTTTATAAGTCTGA  8820
       F  N  L  F  Y  I  I  V  G  F  I  A  Y  I  *  C  L  *  V  *
        L  I  C  F  I  L  L  W  A  L  L  P  T  Y  S  V  Y  K  S  D
         *  S  V  L  Y  Y  C  G  L  Y  C  L  H  I  V  F  I  S  L  I

8821  TATTCATTTGCCTGCTTATGCTAGTTTTAAAGTTATTGATAATGGTGTTGTTAGAGATAT  8880
       Y  S  F  A  C  L  C  *  F  *  S  Y  *  *  W  C  C  *  R  Y
        I  H  L  P  A  Y  A  S  F  K  V  I  D  N  G  V  V  R  D  I
         F  I  C  L  L  M  L  V  L  K  L  L  I  M  V  L  L  E  I  F

8881  TTCAGTTAATGATTTATGTTTTGCTAATAAATTTTTCCAATTTGATCAATGGTATGAGTC  8940
       F  S  *  *  F  M  F  C  *  *  I  F  P  I  *  S  M  V  *  V
        S  V  N  D  L  C  F  A  N  K  F  F  Q  F  D  Q  W  Y  E  S
         Q  L  M  I  Y  V  L  L  I  N  F  S  N  L  I  N  G  M  S  P

8941  CACTTTTGGGTCTGTTTACTATCATAATTCTATGGATTGCCCTATTGTAGTGGCAGTTAT  9000
       H  F  W  V  C  L  L  S  *  F  Y  G  L  P  Y  C  S  G  S  Y
        T  F  G  S  V  Y  Y  H  N  S  M  D  C  P  I  V  V  A  V  M
         L  L  G  L  F  T  I  I  I  L  W  I  A  L  L  *  W  Q  L  W

9001  GGATGAAGATATCGGTTCTACTATGTTTAATGTTCCTACTAAAGTTTTGAGACATGGCTT  9060
       G  *  R  Y  R  F  Y  Y  V  *  C  S  Y  *  S  F  E  T  W  L
        D  E  D  I  G  S  T  M  F  N  V  P  T  K  V  L  R  H  G  F
         M  K  I  S  V  L  L  C  L  M  F  L  L  K  F  *  D  M  A  F

9061  TCATGTTTTACATTTTTTAACTTATGCATTTGCTAGTGATAGTGTTCAGTGCTATACACC  9120
       S  C  F  T  F  F  N  L  C  I  C  *  *  *  C  S  V  L  Y  T
        H  V  L  H  F  L  T  Y  A  F  A  S  D  S  V  Q  C  Y  T  P
         M  F  Y  I  F  *  L  M  H  L  L  V  I  V  F  S  A  I  H  H

9121  ACATATTCAGATTTCTTATAATGATTTTTATGCTAGTGGTTGTGTTTTATCATCTTTGTG  9180
       T  Y  S  D  F  L  *  *  F  L  C  *  W  L  C  F  I  I  F  V
        H  I  Q  I  S  Y  N  D  F  Y  A  S  G  C  V  L  S  S  L  C
         I  F  R  F  L  I  M  I  F  M  L  V  V  V  F  Y  H  L  C  V
```

FIG. 2 CONT'D

```
9181  TACTATGTTTAAAAGAGGTGATGGTACACCACATCCTTATTGTTATTCAGATGGTGTTAT  9240
       Y  Y  V  *  K  R  *  W  Y  T  T  S  L  L  L  F  R  W  C  Y
        T  M  F  K  R  G  D  G  T  P  H  P  Y  C  Y  S  D  G  V  M
         L  C  L  K  E  V  M  V  H  H  I  L  I  V  I  Q  M  V  L  *

9241  GAAGAATGCTTCTTTGTATACATCTTTGGTTCCACATACACGTTATAGCCTTGCTAATTC  9300
       E  E  C  F  F  V  Y  I  F  G  S  T  Y  T  L  *  P  C  *  F
        K  N  A  S  L  Y  T  S  L  V  P  H  T  R  Y  S  L  A  N  S
         R  M  L  L  C  I  H  L  W  F  H  I  H  V  I  A  L  L  I  L

9301  TAATGGTTTTATAAGATTTCCTGATGTTATTAGTGAAGGTATTGTACGTATTGTAAGAAC  9360
       *  W  F  Y  K  I  S  *  C  Y  *  *  R  Y  C  T  Y  C  K  N
        N  G  F  I  R  F  P  D  V  I  S  E  G  I  V  R  I  V  R  T
         M  V  L  *  D  F  L  M  L  L  V  K  V  L  Y  V  L  *  E  R

9361  GCGCTCTATGACTTATTGTAGAGTGGGTGCATGTGAATACGCCGAAGAGGGTATATGTTT  9420
       A  L  Y  D  L  L  *  S  G  C  M  *  I  R  R  R  G  Y  M  F
        R  S  M  T  Y  C  R  V  G  A  C  E  Y  A  E  E  G  I  C  F
         A  L  *  L  I  V  E  W  V  H  V  N  T  P  K  R  V  Y  V  L

9421  TAATTTTAATAGTTCCTGGGTTTTGAATAATGATTATTATAGAAGTATGCCTGGAACTTT  9480
       *  F  *  *  F  L  G  F  E  *  *  L  L  *  K  Y  A  W  N  F
        N  F  N  S  S  W  V  L  N  N  D  Y  Y  R  S  M  P  G  T  F
         I  L  I  V  P  G  F  *  I  M  I  I  I  E  V  C  L  E  L  F

9481  TTGTGGTAGAGATCTTTTTGATTTGTTTTATCAATTTTTTAGTAGTTTAATTCGTCCTAT  9540
       L  W  *  R  S  F  *  F  V  L  S  I  F  *  *  F  N  S  S  Y
        C  G  R  D  L  F  D  L  F  Y  Q  F  F  S  S  L  I  R  P  I
         V  V  E  I  F  L  I  C  F  I  N  F  L  V  V  *  F  V  L  *

9541  AGATTTCTTTTCTCTTACTGCTAGTTCTATTTTTGGAGCTATATTGGCTATAGTTGTTGT  9600
       R  F  L  F  S  Y  C  *  F  Y  F  W  S  Y  I  G  Y  S  C  C
        D  F  F  S  L  T  A  S  S  I  F  G  A  I  L  A  I  V  V  V
         I  S  F  L  L  L  V  L  F  L  E  L  Y  W  L  *  L  L  S

9601  CTTGGTTTTTTATTATTTAATAAAACTTAAGCGTGCTTTTGGAGATTATACTAGTGTTGT  9660
       L  G  F  L  L  F  N  K  T  *  A  C  F  W  R  L  Y  *  C  C
        L  V  F  Y  Y  L  I  K  L  K  R  A  F  G  D  Y  T  S  V  V
         W  F  F  I  I  *  *  N  L  S  V  L  L  E  I  I  L  V  L  *

9661  AGTTATAAATGTTGTTGTTTGGTGTATTAATTTTCTTATGCTTTTTGTTTTTCAAGTTTA  9720
       S  Y  K  C  C  C  L  V  Y  *  F  S  Y  A  F  C  F  S  S  L
        V  I  N  V  V  V  W  C  I  N  F  L  M  L  F  V  F  Q  V  Y
         L  *  M  L  L  F  G  V  L  I  F  L  C  F  L  F  F  K  F  I
```

FIG. 2 CONT'D

```
9721  TCCTATTTGTGCATGTGTTTATGCTTGTTTTTATTTTTATGTAACATTGTATTTTCCTTC  9780
       S Y L C M C L F L F L C N I V F S F
        P I C A C V Y A C F Y F Y V T L Y F P S
         L F V H V F M L V F I F M * H C I F L L

9781  TGAAATTAGTGTAATTATGCATTTGCAATGGATTGTTATGTATGGTGCTATAATGCCTTT  9840
       * N * C N Y A F A M D C Y V W C Y N A F
        E I S V I M H L Q W I V M Y G A I M P F
         K L V * L C I C N G L L C M V L * C L F

9841  TTGGTTTTGTGTCACATATGTAGCTATGGTTATTGCAAACCATGTTTTATGGTTATTTTC  9900
       L V L C H I C S Y G Y C K P C F M V I F
        W F C V T Y V A M V I A N H V L W L F S
         G F V S H M * L W L L Q T M F Y G Y F H

9901  ATATTGTAGGAAAATTGGTGTTAATGTATGTAGTGATAGTACATTTGAAGAAACATCTCT  9960
       I L * E N W C * C M * * * Y I * R N I S
        Y C R K I G V N V C S D S T F E E T S L
         I V G K L V L M Y V V I V H L K K H L L

9961  TACTACTTTTATGATTACTAAAGATTCTTATTGTAGATTAAAGAATTCTGTTTCTGATGT  10020
       Y Y F Y D Y * R F L L * I K E F C F * C
        T T F M I T K D S Y C R L K N S V S D V
         L L L * L L K I L I V D * R I L F L M L

10021 TGCCTACAATAGATATTTGAGTTTGTATAATAAGTATCGTTACTATAGTGGTAAAATGGA  10080
       C L Q * I F E F V * * V S L L * W * N G
        A Y N R Y L S L Y N K Y R Y Y S G K M D
         P T I D I * V C I I S I V T I V V K W I

10081 TACTGCTGCCTATAGAGAAGCGGCGTGTTCTCAGTTAGCTAAAGCTATGGAAACATTTAA  10140
       Y C C L * R S G V F S V S * S Y G N I *
        T A A Y R E A A C S Q L A K A M E T F N
         L L P I E K R R V L S * L K L W K H L I

10141 TCACAATAATGGTAATGATGTCTTATACCAACCTCCTACAGCATCTGTTTCTACATCTTT  10200
       S Q * W * * C L I P T S Y S I C F Y I F
        H N N G N D V L Y Q P P T A S V S T S F
         T I M V M M S Y T N L L Q H L F L H L F

10201 TTTGCAATCAGGTATTGTAAAGATGGTATCTCCTACGTCAAAAATTGAACCTTGTATTGT  10260
       F A I R Y C K D G I S Y V K N * T L Y C
        L Q S G I V K M V S P T S K I E P C I V
         C N Q V L * R W Y L L R Q K L N L V L L
```

FIG. 2 CONT'D

| | | |
|---|---|---|
| 10261 | TAGTGTTACTTATGGTAGTATGACTTTGAATGGTTTATGGTTAGATGACAAAGTTTATTG | 10320 |
| | \* C Y L W \* Y D F E W F M V R \* Q S L L | |
| | S V T Y G S M T L N G L W L D D K V Y C | |
| | V L L M V V \* L \* M V Y G \* M T K F I V | |
| | | |
| 10321 | TCCTCGTCATGTTATATGTTCATCCTCTAATATGAACGAACCTGATTATTCTGCCTTATT | 10380 |
| | S S S C Y M F I L \* Y E R T \* L F C L I | |
| | P R H V I C S S N M N E P D Y S A L L | |
| | L V M L Y V H P L I \* T N L I I L P Y C | |
| | | |
| 10381 | GTGTAGAGTTACTCTAGGTGATTTTACTATAATGTCTGGTCGGATGAGTTTAACAGTTGT | 10440 |
| | V \* S Y S R \* F Y Y N V W S D E F N S C | |
| | C R V T L G D F T I M S G R M S L T V V | |
| | V E L L \* V I L L \* C L V G \* V \* Q L C | |
| | | |
| 10441 | GTCTTACCAGATGCAGGGCTGTCAACTTGTTTTGACAGTCTCTTTACAAAATCCTTACAC | 10500 |
| | V L P D A G L S T C F D S L F T K S L H | |
| | S Y Q M Q G C Q L V L T V S L Q N P Y T | |
| | L T R C R A V N L F \* Q S L Y K I L T L | |
| | | |
| 10501 | TCCAAAATATACTTTTGGTAATGTTAAACCTGGTGAAACTTTTACTGTTTTAGCTGCGTA | 10560 |
| | S K I Y F W \* C \* T W \* N F Y C F S C V | |
| | P K Y T F G N V K P G E T F T V L A A Y | |
| | Q N I L L V M L N L V K L L F \* L R I | |
| | | |
| 10561 | TAATGGCCGACCACAAGGGGCATTTCATGTTACTATGCGTAGTAGTTATACTATTAAAGG | 10620 |
| | \* W P T T R G I S C Y Y A \* \* L Y Y \* R | |
| | N G R P Q G A F H V T M R S S Y T I K G | |
| | M A D H K G H F M L L C V V V I L L K V | |
| | | |
| 10621 | TTCTTTTTTGTGTGGGTCATGTGGATCTGTTGGTTATGTATTAACAGGTGATAGTGTTAA | 10680 |
| | F F F V W V M W I C W L C I N R \* \* C \* | |
| | S F L C G S C G S V G Y V L T G D S V K | |
| | L F C V G H V D L L V M Y \* Q V I V L S | |
| | | |
| 10681 | GTTTGTATATATGCATCAATTAGAGCTCAGTACTGGTTGTCACACTGGCACTGATTTTAC | 10740 |
| | V C I Y A S I R A Q Y W L S H W H \* F Y | |
| | F V Y M H Q L E L S T G C H T G T D F T | |
| | L Y I C I N \* S S V L V V T L A L I L L | |
| | | |
| 10741 | TGGTAATTTTTATGGTCCATATAGAGATGCTCAAGTTGTACAGTTGCCAGTTAAGGACTA | 10800 |
| | W \* F L W S I \* R C S S C T V A S \* G L | |
| | G N F Y G P Y R D A Q V V Q L P V K D Y | |
| | V I F M V H I E M L K L Y S C Q L R T T | |

FIG. 2 CONT'D

```
10801   CGTCCAGACTGTTAATGTTATTGCTTGGCTCTATGCAGCTATACTTAATAATTGTGCTTG   10860
        R  P  D  C  *  C  Y  C  L  A  L  C  S  Y  T  *  *  L  C  L
         V  Q  T  V  N  V  I  A  W  L  Y  A  A  I  L  N  N  C  A  W
          S  R  L  L  M  L  L  G  S  M  Q  L  Y  L  I  I  V  L  G

10861   GTTTGTACAAAATGATGTTTGTTCTACTGAAGATTTTAATGTTTGGGCTATGGCAAATGG   10920
        V  C  T  K  *  C  L  F  Y  *  R  F  *  C  L  G  Y  G  K  W
         F  V  Q  N  D  V  C  S  T  E  D  F  N  V  W  A  M  A  N  G
          L  Y  K  M  M  F  V  L  L  K  I  L  M  F  G  L  W  Q  M  V

10921   TTTTAGCCAAGTAAAAGCAGATCTTGTCTTAGATGCTTTGGCTTCAATGACAGGTGTTTC   10980
        F  *  P  S  K  S  R  S  C  L  R  C  F  G  F  N  D  R  C  F
         F  S  Q  V  K  A  D  L  V  L  D  A  L  A  S  M  T  G  V  S
          L  A  K  *  K  Q  I  L  S  *  M  L  W  L  Q  *  Q  V  F  L

10981   TATTGAAACTTTATTGGCTGCTATTAAGCGTCTATATATGGGATTTCAAGGTCGTCAAAT   11040
        Y  *  N  F  I  G  C  Y  *  A  S  I  Y  G  I  S  R  S  S  N
         I  E  T  L  L  A  A  I  K  R  L  Y  M  G  F  Q  G  R  Q  I
          L  K  L  Y  W  L  L  S  V  Y  I  W  D  F  K  V  V  K  Y

11041   ACTAGGAAGTTGTACTTTTGAAGATGAATTGGCACCTTCTGACGTTTATCAACAATTGGC   11100
        T  R  K  L  Y  F  *  R  *  I  G  T  F  *  R  L  S  T  I  G
         L  G  S  C  T  F  E  D  E  L  A  P  S  D  V  Y  Q  Q  L  A
          *  E  V  V  L  L  K  M  N  W  H  L  L  T  F  I  N  N  W  L

11101   TGGTGTTAAATTGCAATCTAAAACAAAAAGATTTATTAAAGAAACAATTTATTGGATTTT   11160
        W  C  *  I  A  I  *  N  K  K  I  Y  *  R  N  N  L  L  D  F
         G  V  K  L  Q  S  K  T  K  R  F  I  K  E  T  I  Y  W  I  L
          V  L  N  C  N  L  K  Q  K  D  L  L  K  K  Q  F  I  G  F  *

11161   GATATCTACATTTTTGTTTAGTTGTATAATTTCTGCATTTGTTAAATGGACTATATTTAT   11220
        D  I  Y  I  F  V  *  L  Y  N  F  C  I  C  *  M  D  Y  I  Y
         I  S  T  F  L  F  S  C  I  I  S  A  F  V  K  W  T  I  F  M
          Y  L  H  F  C  L  V  V  *  F  L  H  L  L  N  G  L  Y  L  C

11221   GTATATTAATACACATATGATTGGTGTTACATTATGTGTACTTTGTTTTGTTAGTTTTAT   11280
        V  Y  *  Y  T  Y  D  W  C  Y  I  M  C  T  L  F  C  *  F  Y
         Y  I  N  T  H  M  I  G  V  T  L  C  V  L  C  F  V  S  F  M
          I  L  I  H  I  *  L  V  L  H  Y  V  V  Y  F  V  L  L  V  *

11281   GATGTTACTAGTTAAACATAAGCATTTTTATTTGACTATGTATATAATTCCTGTACTCTG   11340
        D  V  T  S  *  T  *  A  F  L  F  D  Y  V  Y  N  S  C  T  L
         M  L  L  V  K  H  K  H  F  Y  L  T  M  Y  I  I  P  V  L  C
          C  Y  *  L  N  I  S  I  F  I  *  L  C  I  *  F  L  Y  S  V
```

FIG. 2 CONT'D

```
11341  TACCTTGTTTTATGTAAATTATTTAGTTGTTTATAAGGAAGGTTTTAGAGGTTTTACTTA  11400
        Y  L  V  L  C  K  L  F  S  C  L  *  G  R  F  *  R  F  Y  L
         T  L  F  Y  V  N  Y  L  V  V  Y  K  E  G  F  R  G  F  T  Y
          P  C  F  M  *  I  I  *  L  F  I  R  K  V  L  E  V  L  L  M

11401  TGTCTGGCTCTCATATTTTGTTCCTGCTGTGAATTTTACTTATGTTTATGAAGTATTTTA  11460
        C  L  A  L  I  F  C  S  C  C  E  F  Y  L  C  L  *  S  I  L
         V  W  L  S  Y  F  V  P  A  V  N  F  T  Y  V  V  Y  E  V  F  Y
          S  G  S  H  I  L  F  L  L  *  I  L  L  M  F  M  K  Y  F  M

11461  TGGTTGTATTTTATGTGTTTTTGCTATTTTTATAACTATGCATAGTATTAATCATGACAT  11520
        W  L  Y  F  M  C  F  C  Y  F  Y  N  Y  A  *  Y  *  S  *  H
         G  C  I  L  C  V  F  A  I  F  I  T  M  H  S  I  N  H  D  I
          V  V  F  Y  V  F  L  L  F  L  *  L  C  I  V  L  I  M  T  F

11521  TTTTTCTTTGATGTTTTTGGTTGGTAGAATAGTTACTTTAATTTCTATGTGGTATTTTGG  11580
        F  F  F  D  V  F  G  W  *  N  S  Y  F  N  F  Y  V  V  F  W
         F  S  L  M  F  L  V  G  R  I  V  T  L  I  S  M  W  Y  F  G
          F  L  *  C  F  W  L  V  E  *  L  L  *  F  L  C  G  I  L  G

11581  GTCGAATTTAGAAGAGGATGTTTTGTTATTTATTACAGCCTTTTTAGGTACTTATACATG  11640
        V  E  F  R  R  G  C  F  V  I  Y  Y  S  L  F  R  Y  L  M
         S  N  L  E  E  D  V  L  L  F  I  T  A  F  L  G  T  Y  T  W
          R  I  *  K  R  M  F  C  Y  L  L  Q  P  F  *  V  L  I  H  G

11641  GACCACTATTTTGTCATTAGCTATAGCAAAAATTGTTGCTAATTGGTTGTCTGTTAATAT  11700
        D  H  Y  F  V  I  S  Y  S  K  N  C  C  *  L  V  V  C  *  Y
         T  T  I  L  S  L  A  I  A  K  I  V  A  N  W  L  S  V  N  I
          P  L  F  C  H  *  L  *  Q  K  L  L  L  I  G  C  L  L  I  Y

11701  ATTTTATTTTACAGATGTACCTTATATTAAATTGATTCTCTTGAGTTACTTATTTATAGG  11760
        I  L  F  Y  R  C  T  L  Y  *  I  D  S  L  E  L  L  I  Y  R
         F  Y  F  T  D  V  P  Y  I  K  L  I  L  L  S  Y  L  F  I  G
          F  I  L  Q  M  Y  L  I  L  N  *  F  S  *  V  T  Y  L  *  G

11761  GTATATTTTATCTTGTTATTGGGGATTTTTCTCTCTTTTAAACAGTGTTTTTAGAATGCC  11820
        V  Y  F  I  L  L  L  G  I  F  L  S  F  K  Q  C  F  *  N  A
         Y  I  L  S  C  Y  W  G  F  F  S  L  L  N  S  V  F  R  M  P
          I  F  Y  L  V  I  G  D  F  S  L  F  *  T  V  F  L  E  C  L

11821  TATGGGTGTTTATAATTATAAAATTTCTGTTCAAGAATTGCGTTATATGAATGCTAATGG  11880
        Y  G  C  L  *  L  *  N  F  C  S  R  I  A  L  Y  E  C  *  W
         M  G  V  Y  N  Y  K  I  S  V  Q  E  L  R  Y  M  N  A  N  G
          W  V  F  I  I  I  K  F  L  F  K  N  C  V  I  *  M  L  M  A
```

FIG. 2 CONT'D

```
11881   CTTACGTCCACCTCGTAATAGTTTTGAGGCTATTTTGTTAAATTTAAAACTGCTTGGAAT   11940
         L  T  S  T  S  *  *  F  *  G  Y  F  V  K  F  K  T  A  W  N
          L  R  P  P  R  N  S  F  E  A  I  L  L  N  L  K  L  L  G  I
            Y  V  H  L  V  I  V  L  R  L  F  C  *  I  *  N  C  L  E  *

11941   AGGTGGCGTGCCAGTTATTGAAGTCTCCCAAATTCAATCAAAATTGACTGATGTGAAATG   12000
         R  W  R  A  S  Y  *  S  L  P  N  S  I  K  I  D  *  C  E  M
          G  G  V  P  V  I  E  V  S  Q  I  Q  S  K  L  T  D  V  K  C
            V  A  C  Q  L  L  K  S  P  K  F  N  Q  N  *  L  M  *  N  V

12001   TGCTAATGTTGTTTTGTTAAATTGTTTACAGCATTTGCATGTTGCTTCTAATTCTAAGTT   12060
         C  *  C  C  F  V  K  L  F  T  A  F  A  C  C  F  *  F  *  V
          A  N  V  V  L  L  N  C  L  Q  H  L  H  V  A  S  N  S  K  L
            L  M  L  F  C  *  I  V  Y  S  I  C  M  L  L  L  I  L  S  C

12061   GTGGCAGTATTGTAGTGTTTTACATAATGAAATACTATCTACTTCAGATTTGAGTGTAGC   12120
         V  A  V  L  *  C  F  T  *  *  N  T  I  Y  F  R  F  E  C  S
          W  Q  Y  C  S  V  L  H  N  E  I  L  S  T  S  D  L  S  V  A
            G  S  I  V  V  F  Y  I  M  K  Y  Y  L  L  Q  I  *  V  *  L

12121   TTTTGATAAGCTTGCTCAATTATTGATTGTTTTATTCGCCAATCCTGCTGCAGTTGATAC   12180
         F  *  *  A  C  S  I  I  D  C  F  I  R  Q  S  C  C  S  *  Y
          F  D  K  L  A  Q  L  L  I  V  L  F  A  N  P  A  A  V  D  T
            L  I  S  L  L  N  Y  *  L  F  Y  S  P  I  L  L  Q  L  I  L

12181   TAAGTGTCTTGCAAGTATAGATGAAGTTAGCGATGATTATGTTCAAGATAGTACCGTTTT   12240
         *  V  S  C  K  Y  R  *  S  *  R  *  L  C  S  R  *  Y  R  F
          K  C  L  A  S  I  D  E  V  S  D  D  Y  V  Q  D  S  T  V  L
            S  V  L  Q  V  *  M  K  L  A  M  I  M  F  K  I  V  P  F  C

12241   GCAGGCTTTGCAAAGTGAGTTTGTAAATATGGCTAGTTTTGTTGAATATGAAGTCGCAAA   12300
         A  G  F  A  K  *  V  C  K  Y  G  *  F  C  *  I  *  S  R  K
          Q  A  L  Q  S  E  F  V  N  M  A  S  F  V  E  Y  E  V  A  K
            R  L  C  K  V  S  L  *  I  W  L  V  L  L  N  M  K  S  Q  R

12301   GAAAAATTTGGCTGATGCTAAAAATAGTGGTTCTGTTAATCAACAACAGATAAAACAGTT   12360
         E  K  F  G  *  C  *  K  *  W  F  C  *  S  T  T  D  K  T  V
          K  N  L  A  D  A  K  N  S  G  S  V  N  Q  Q  Q  I  K  Q  L
            K  I  W  L  M  L  K  I  V  V  L  L  I  N  N  R  *  N  S  *

12361   AGAAAAAGCATGTAATATAGCTAAGTCTGTGTATGAACGTGATAAAGCTGTAGCTCGCAA   12420
         R  K  S  M  *  Y  S  *  V  C  V  *  T  *  *  S  C  S  S  Q
          E  K  A  C  N  I  A  K  S  V  Y  E  R  D  K  A  V  A  R  K
            K  K  H  V  I  *  L  S  L  C  M  N  V  I  K  L  *  L  A  N
```

FIG. 2 CONT'D

```
12421   ACTTGAACGTATGGCAGACCTAGCACTTACTAACATGTATAAAGAGGCTCGGATTAATGA   12480
         T * T Y G R P S T Y * H V * R G S D * *
          L E R M A D L A L T N M Y K E A R I N D
           L N V W Q T * H L L T C I K R L G L M I

12481   TAAGAAGAGTAAAGTTGTTTCCGCTTTGCAGACAATGCTTTTTAGCATGGTTCGTAAATT   12540
         * E E * S C F R F A D N A F * H G S * I
          K K S K V V S A L Q T M L F S M V R K L
           R R V K L F P L C R Q C F L A W F V N W

12541   GGATAATCAGGCTTTAAATTCTATTCTGGATAATGCTGTTAAAGGTTGTGTACCTTTGAG   12600
         G * S G F K F Y S G * C C * R L C T F E
          D N Q A L N S I L D N A V K G C V P L S
           I I R L * I L F W I M L L K V V Y L * V

12601   TGCTATTCCAGCATTGGCTGCTAATACTTTAACTATAGTAATACCAGATAAACAAGTTTT   12660
         C Y S S I G C * Y F N Y S N T R * T S F
          A I P A L A A N T L T I V I P D K Q V F
           L F Q H W L L I L * L * * Y Q I N K F L

12661   TGATAAAGTTGTTGATAATGTTTATGTTACATATGCTGGTAGTGTATGGCATATACAGAC   12720
         * * S C * * C L C Y I C W * C M A Y T D
          D K V V D N V Y V T Y A G S V W H I Q T
           I K L L I M F M L H M L V V Y G I Y R L

12721   TGTTCAAGATGCTGATGGTATTAATAAACAGTTAACTGATATTAGTGTTGATTCTAATTG   12780
         C S R C * W Y * * T V N * Y * C * F * L
          V Q D A D G I N K Q L T D I S V D S N W
           F K M L M V L I N S * L I L V L I L I G

12781   GCCTCTTGTTATCATTGCGAACAGGTATAATGAAGTTGCTAATGCTGTTATGCAGAATAA   12840
         A S C Y H C E Q V * * S C * C C Y A E *
          P L V I I A N R Y N E V A N A V M Q N N
           L L L S L R T G I M K L L M L L C R I M

12841   TGAGTTGATGCCTCATAAATTAAAAATACAAGTTGTTAATAGTGGTTCTGATATGAATTG   12900
         * V D A S * I K N T S C * * W F * Y E L
          E L M P H K L K I Q V V N S G S D M N C
           S * C L I N * K Y K L L I V V L I * I V

12901   TAATATTCCTACTCAATGTTATTATAATAATGGTAGTAGTGGTAGAATAGTTTATGCTGT   12960
         * Y S Y S M L L * * W * * W * N S L C C
          N I P T Q C Y Y N N G S S G R I V Y A V
           I F L L N V I I I M V V V E * F M L F
```

FIG. 2 CONT'D

| | | |
|---|---|---|
| 12961 | TCTTAGTGATGTTGATGGTCTTAAGTATACTAAGATAATGAAAGATGATGGAAATTGTGT | 13020 |
| | S * * C * W S * V Y * D N E R * W K L C | |
| | L S D V D G L K Y T K I M K D D G N C V | |
| | L V M L M V L S I L R * * K M M E I V L | |
| 13021 | TGTTTTAGAGCTTGATCCTCCTTGTAAATTTTCTATACAAGATGTTAAGGGACTTAAAAT | 13080 |
| | C F R A * S S L * I F Y T R C * G T * N | |
| | V L E L D P P C K F S I Q D V K G L K I | |
| | F * S L I L L V N F L Y K M L R D L K L | |
| 13081 | TAAGTATCTTTATTTTATTAAAGGATGTAACACTTTAGCTAGAGGGTGGGTTGTTGGTAC | 13140 |
| | * V S L F Y * R M * H F S * R V G C W Y | |
| | K Y L Y F I K G C N T L A R G W V V G T | |
| | S I F I L L K D V T L * L E G G L L V L | |
| 13141 | TTTATCTTCAACAATTAGATTGCAGGCTGGTGTTGCTACTGAGTATGCAGCTAATTCTTC | 13200 |
| | F I F N N * I A G W C C Y * V C S * F F | |
| | L S S T I R L Q A G V A T E Y A A N S S | |
| | Y L Q Q L D C R L V L L S M Q L I L L | |
| 13201 | TATACTTTCATTATGTGCATTTTCTGTAGATCCTAAGAAAACTTATTTAGATTATATACA | 13260 |
| | Y T F I M C I F C R S * E N L F R L Y T | |
| | I L S L C A F S V D P K K T Y L D Y I Q | |
| | Y F H Y V H F L * I L R K L I * I I Y N | |
| 13261 | ACAAGGTGGTGTACCTATAATTAATTGTGTTAAAATGCTCTGTGATCATGCTGGTACTGG | 13320 |
| | T R W C T Y N * L C * N A L * S C W Y W | |
| | Q G G V P I I N C V K M L C D H A G T G | |
| | K V V Y L * L I V L K C S V I M L V L V | |
| 13321 | TATGGCCATTACTATTAAACCTGAGGCTACTATTAACCAAGATTCTTATGGTGGTGCCTC | 13380 |
| | Y G H Y Y * T * G Y Y * P R F L W W C L | |
| | M A I T I K P E A T I N Q D S Y G G A S | |
| | W P L L L N L R L L L T K I L M V V P Q | |
| 13381 | AGTTTGTATTTATTGCCGTGCACGTGTAGAGCATCCAGATGTAGATGGTATATGTAAATT | 13440 |
| | S L Y L L P C T C R A S R C R W Y M * I | |
| | V C I Y C R A R V E H P D V D G I C K L | |
| | F V F I A V H V * S I Q M * M V Y V N Y | |
| 13441 | ACGTGGTAAATTTGTACAAGTCCCTTTGGGTATAAAAGATCCTATTCTTTATGTGTTAAC | 13500 |
| | T W * I C T S P F G Y K R S Y S L C V N | |
| | R G K F V Q V P L G I K D P I L Y V L T | |
| | V V N L Y K S L W V * K I L F F M C * H | |

FIG. 2 CONT'D

| | | |
|---|---|---|
| 13501 | ACATGATGTTTGTCAAGTCTGTGGTTTTTGGAGAGATGGCAGTTGTTCCTGTGTAGGTTC | 13560 |
| | T * C L S S L W F L E R W Q L F L C R F | |
| | H D V C Q V C G F W R D G S C S C V G S | |
| | M M F V K S V V F G E M A V V P V * V Q | |
| 13561 | AAGTGTCGCTGTTCAATCTAAAGATTTAAATTTTTTAAACGGGTTCGGGGTACTAGTGTG | 13620 |
| | K C R C S I * R F K F F K R V R G T S V | |
| | S V A V Q S K D L N F L N G F G V L V * | |
| | V S L F N L K I * I F * T G S G Y * C E | |
| 13621 | AATGCCCGGCTAGTACCCTGTGCTAGTGGTTTATCTACTGATGTTCAATTAAGGGCATTT | 13680 |
| | N A R L V P C A S G L S T D V Q L R A F | |
| | M P G * Y P V L V V Y L L M F N * G H L | |
| | C P A S T L C * W F I Y * C S I K G I * | |
| 13681 | GACATTTGTAATACCAATAGAGCTGGTATAGGTTTATATTATAAAGTGAATTGTTGCCGT | 13740 |
| | D I C N T N R A G I G L Y Y K V N C C R | |
| | T F V I P I E L V * V Y I I K * I V A V | |
| | H L * Y Q * S W Y R F I L * S E L L P F | |
| 13741 | TTTCAGCGTATAGATGACGACGGTAATAAATTGGATAAGTTCTTTGTTGTCAAAAGAACT | 13800 |
| | F Q R I D D D G N K L D K F F V V K R T | |
| | F S V * M T T V I N W I S S L L S K E L | |
| | S A Y R * R R * * I G * V L C C Q K N * | |
| 13801 | AATTTAGAAGTTTATAATAAAGAGAAAACTTATTATGAGTTGACTAAAAGTTGTGGTGTT | 13860 |
| | N L E V Y N K E K T Y Y E L T K S C G V | |
| | I * K F I I K R K L I M S * L K V V V L | |
| | F R S L * * R E N L L * V D * K L W C C | |
| 13861 | GTGGCTGAACATGATTTCTTTACATTTGATATTGATGGTAGTCGCGTGCCACATATAGTT | 13920 |
| | V A E H D F F T F D I D G S R V P H I V | |
| | W L N M I S L H L I L M V V A C H I * F | |
| | G * T * F L Y I * Y * W * S R A T Y S S | |
| 13921 | CGTAGGAATCTTTCAAAGTATACTATGTTAGATCTTTGCTATGCATTGCGTCATTTTGAT | 13980 |
| | R R N L S K Y T M L D L C Y A L R H F D | |
| | V G I F Q S I L C * I F A M H C V I L I | |
| | * E S F K V Y Y V R S L L C I A S F * S | |
| 13981 | CGTAATGATTGTTCAATATTGTGTGAAATTCTTTGTGAGTATGCTGATTGTAAAGAATCC | 14040 |
| | R N D C S I L C E I L C E Y A D C K E S | |
| | V M I V Q Y C V K F F V S M L I V K N P | |
| | * * L F N I V * N S L * V C * L * R I L | |

FIG. 2 CONT'D

```
14041  TACTTTTCTAAGAAAGATTGGTATGATTTTGTTGAAAATCCTGATATTATTAATATATAT  14100
        Y  F  S  K  K  D  W  Y  D  F  V  E  N  P  D  I  I  N  I  Y
         T  F  L  R  K  I  G  M  I  L  L  K  I  L  I  L  L  I  Y  I
          L  F  *  E  R  L  V  *  F  C  *  K  S  *  Y  Y  *  Y  I  *

14101  AAAAAATTAGGCCCTATTTTTAATAGAGCTTTACTTAATACTGTCATTTTTGCAGACACC  14160
        K  K  L  G  P  I  F  N  R  A  L  L  N  T  V  I  F  A  D  T
         K  N  *  A  L  F  L  I  E  L  Y  L  I  L  S  F  L  Q  T  P
          K  I  R  P  Y  F  *  *  S  F  T  *  Y  C  H  F  C  R  H  L

14161  TTAGTTGAAGTAGGTTTAGTTGGTGTTTTAACTTTAGATAACCAAGATTTGTATGGTCAA  14220
        L  V  E  V  G  L  V  G  V  L  T  L  D  N  Q  D  L  Y  G  Q
         *  L  K  *  V  *  L  V  F  *  L  *  I  T  K  I  C  M  V  N
          S  *  S  R  F  S  W  C  F  N  F  R  *  P  R  F  V  W  S  M

14221  TGGTATGATTTTGGTGATTTTATACAAACAGCCCCAGGGTTTGGTGTGGCAGTTGCAGAT  14280
        W  Y  D  F  G  D  F  I  Q  T  A  P  G  F  G  V  A  V  A  D
         G  M  I  L  V  I  L  Y  K  Q  P  Q  G  L  V  W  Q  L  Q  I
          V  *  F  W  *  F  Y  T  N  S  P  R  V  W  C  G  S  C  R  F

14281  TCTTACTATTCTTATATGATGCCTATGTTGACTATGTGTCATGTATTAGATTGTGAATTA  14340
        S  Y  Y  S  Y  M  M  P  M  L  T  M  C  H  V  L  D  C  E  L
         L  T  I  L  I  *  C  L  C  *  L  C  V  M  Y  *  I  V  N  Y
          L  L  F  L  Y  D  A  Y  V  D  Y  V  S  C  I  R  L  *  I  I

14341  TTTGTTAATGATAGTTATAGACAATTCGATCTTGTACAGTATGATTTTACTGATTACAAG  14400
        F  V  N  D  S  Y  R  Q  F  D  L  V  Q  Y  D  F  T  D  Y  K
         L  L  M  I  V  I  D  N  S  I  L  Y  S  M  I  L  L  I  T  S
          C  *  *  *  L  *  T  I  R  S  C  T  V  *  F  Y  *  L  Q  V

14401  TTAGAGTTGTTTAATAAGTATTTTAAGTATTGGGGTATGAAGTATCATCCTAATACTGTG  14460
        L  E  L  F  N  K  Y  F  K  Y  W  G  M  K  Y  H  P  N  T  V
         *  S  C  L  I  S  I  L  S  I  G  V  *  S  I  I  L  I  L  W
          R  V  V  *  *  V  F  *  V  L  G  Y  E  V  S  S  *  Y  C  G

14461  GATTGTGATAATGATAGGTGTATTATTCATTGTGCTAATTTTAATATACTATTTAGTATG  14520
        D  C  D  N  D  R  C  I  I  H  C  A  N  F  N  I  L  F  S  M
         I  V  I  M  I  G  V  L  F  I  V  L  I  L  I  Y  Y  L  V  W
          L  *  *  *  *  V  Y  Y  S  L  C  *  F  *  Y  T  I  *  Y  G

14521  GTTTTACCTAATACTTGTTTTGGTCCCCTTGTTAGACAAATTTTTGTAGATGGTGTACCG  14580
        V  L  P  N  T  C  F  G  P  L  V  R  Q  I  F  V  D  G  V  P
         F  Y  L  I  L  V  L  V  P  L  L  D  K  F  L  *  M  V  Y  R
          F  T  *  Y  L  F  W  S  P  C  *  T  N  F  C  R  W  C  T  V
```

FIG. 2 CONT'D

| | | |
|---|---|---|
| 14581 | TTTGTTGTTTCTATTGGTTACCATTACAAAGAGTTAGGTGTAGTTATGAACTTAGATGTT | 14640 |
| | F V V S I G Y H Y K E L G V V M N L D V | |
| | L L F L L V T I T K S * V * L * T * M L | |
| | C C F Y W L P L Q R V R C S Y E L R C * | |
| | | |
| 14641 | GACACACACCGTTATCGTTTGTCTCTTAAAGATTTACTTCTTTATGCAGCAGATCCTGCT | 14700 |
| | D T H R Y R L S L K D L L L Y A A D P A | |
| | T H T V I V C L L K I Y F F M Q Q I L L | |
| | H T P L S F V S * R F T S L C S R S C Y | |
| | | |
| 14701 | ATGCACGTTGCATCTGCTAGTGCTCTGCTTGATTTACGAACTTGTTGTTTTAGTGTAGCT | 14760 |
| | M H V A S A S A L L D L R T C C F S V A | |
| | C T L H L L V L C L I Y E L V V L V * L | |
| | A R C I C * C S A * F T N L L F * C S C | |
| | | |
| 14761 | GCCATTACAAGTGGTATAAAATTTCAAACTGTAAAACCAGGTAACTTTAACCAAGACTTT | 14820 |
| | A I T S G I K F Q T V K P G N F N Q D F | |
| | P L Q V V * N F K L * N Q V T L T K T F | |
| | H Y K W Y K I S N C K T R * L * P R L L | |
| | | |
| 14821 | TACGAGTTTGTTAAAAGTAAAGGCTTGTTTAAAGAGGGTAGTACAGTTGATTTGAAACAT | 14880 |
| | Y E F V K S K G L F K E G S T V D L K H | |
| | T S L L K V K A C L K R V V Q L I * N I | |
| | R V C * K * R L V * R G * Y S * F E T F | |
| | | |
| 14881 | TTTTTCTTTACTCAAGATGGTAATGCTGCAATTACTGATTATAATTATTATAAGTATAAT | 14940 |
| | F F F T Q D G N A A I T D Y N Y Y K Y N | |
| | F S L L K M V M L Q L L I I I I S I I | |
| | F L Y S R W * C C N Y * L * L L * V * F | |
| | | |
| 14941 | TTACCTACTATGGTTGATATTAAGCAGTTATTGTTTGTATTAGAAGTTGTTTATAAATAT | 15000 |
| | L P T M V D I K Q L L F V L E V V Y K Y | |
| | Y L L W L I L S S Y C L Y * K L F I N I | |
| | T Y Y G * Y * A V I V C I R S C L * I F | |
| | | |
| 15001 | TTTGAAATTTATGATGGTGGTTGTATACCAGCATCACAAGTTATTGTTAATAATTATGAT | 15060 |
| | F E I Y D G G C I P A S Q V I V N N Y D | |
| | L K F M M V V V Y Q H H K L L L I I M I | |
| | * N L * W W L Y T S I T S Y C * * L * * | |
| | | |
| 15061 | AAAAGTGCTGGTTATCCATTTAATAAATTTGGTAAAGCCAGACTTTATTATGAGGCATTA | 15120 |
| | K S A G Y P F N K F G K A R L Y Y E A L | |
| | K V L V I H L I N L V K P D F I M R H Y | |
| | K C W L S I * * I W * S Q T L L * G I I | |

FIG. 2 CONT'D

```
15121   TCATTTGAGGAACAGAATGAAATTTATGCATATACTAAACGTAATGTTCTGCCCACCTTA   15180
         S  F  E  E  Q  N  E  I  Y  A  Y  T  K  R  N  V  L  P  T  L
          H  L  R  N  R  M  K  F  M  H  I  L  N  V  M  F  C  P  P  *
           I  *  G  T  E  *  N  L  C  I  Y  *  T  *  C  S  A  H  L  N

15181   ACTCAAATGAATTTAAAATATGCTATCAGTGCTAAGAATAGAGCTCGCACTGTAGCAGGT   15240
         T  Q  M  N  L  K  Y  A  I  S  A  K  N  R  A  R  T  V  A  G
          L  K  *  I  *  N  M  L  S  V  L  R  I  E  L  A  L  *  Q  V
           S  N  E  F  K  I  C  Y  Q  C  *  E  *  S  S  H  C  S  R  C

15241   GTTTCTATTCTTAGTACTATGACAGGCCGAATGTTCCATCAAAAATGTTTGAAGAGTATA   15300
         V  S  I  L  S  T  M  T  G  R  M  F  H  Q  K  C  L  K  S  I
          F  L  F  L  V  L  *  Q  A  E  C  S  I  K  N  V  *  R  V  *
           F  Y  S  *  Y  Y  D  R  P  N  V  P  S  K  M  F  E  E  Y  S

15301   GCAGCTACCCGAGGTGTTCCTGTTGTTATAGGAACCACTAAATTTTATGGTGGTTGGGAC   15360
         A  A  T  R  G  V  P  V  V  I  G  T  T  K  F  Y  G  G  W  D
          Q  L  P  E  V  F  L  L  L  *  E  P  L  N  F  M  V  V  G  T
           S  Y  P  R  C  S  C  C  Y  R  N  H  *  I  L  W  W  L  G  R

15361   GATATGTTACGTCATCTTATAAAGGATGTTGACAACCCTGTTCTTATGGGTTGGGATTAT   15420
         D  M  L  R  H  L  I  K  D  V  D  N  P  V  L  M  G  W  D  Y
          I  C  Y  V  I  L  *  R  M  L  T  T  L  F  L  W  V  G  I  I
           Y  V  T  S  S  Y  K  G  C  *  Q  P  C  S  Y  G  L  G  L  S

15421   CCTAAATGTGATCGTGCTATGCCAAATATTTTGCGTATTGTTAGTAGTTTAGTTTTGGCC   15480
         P  K  C  D  R  A  M  P  N  I  L  R  I  V  S  S  L  V  L  A
          L  N  V  I  V  L  C  Q  I  F  C  V  L  L  V  V  *  F  W  P
           *  M  *  S  C  Y  A  K  Y  F  A  Y  C  *  *  F  S  F  G  P

15481   CGCAAACATGAATTTTGTTGTTCACATGGTGATAGATTTTATCGCCTTGCGAATGAATGT   15540
         R  K  H  E  F  C  C  S  H  G  D  R  F  Y  R  L  A  N  E  C
          A  N  M  N  F  V  V  H  M  V  I  D  F  I  A  L  R  M  N  V
           Q  T  *  I  L  L  F  T  W  *  *  I  L  S  P  C  E  *  M  C

15541   GCTCAAGTTTTGAGTGAAATAGTTATGTGTGGCGGTTGCTATTATGTTAAGCCTGGTGGT   15600
         A  Q  V  L  S  E  I  V  M  C  G  G  C  Y  Y  V  K  P  G  G
          L  K  F  *  V  K  *  L  C  V  A  V  A  I  M  L  S  L  V  V
           S  S  F  E  *  N  S  Y  V  W  R  L  L  L  C  *  A  W  W  Y

15601   ACTAGCAGTGGTGATGCAACTACTGCTTTTGCTAATTCTGTTTTTAATATATGTCAGGCT   15660
         T  S  S  G  D  A  T  T  A  F  A  N  S  V  F  N  I  C  Q  A
          L  A  V  V  M  Q  L  L  L  L  L  I  L  F  L  I  Y  V  R  L
           *  Q  W  *  C  N  Y  C  F  C  *  F  C  F  *  Y  M  S  G  C
```

FIG. 2 CONT'D

```
15661  GTTACTGCTAATGTTTGTTCTCTTATGGCCTGTAATGGCCATAAGATTGAAGATTTAAGT  15720
        V  T  A  N  V  C  S  L  M  A  C  N  G  H  K  I  E  D  L  S
         L  L  L  M  F  V  L  L  W  P  V  M  A  I  R  L  K  I  *  V
          Y  C  *  C  L  F  S  Y  G  L  *  W  P  *  D  *  R  F  K  Y

15721  ATACGCAATTTACAAAAACGCTTATACTCTAATGTTTATCGTACAGATTATGTTGATTAT  15780
        I  R  N  L  Q  K  R  L  Y  S  N  V  Y  R  T  D  Y  V  D  Y
         Y  A  I  Y  K  N  A  Y  T  L  M  F  I  V  Q  I  M  L  I  I
          T  Q  F  T  K  T  L  I  L  *  C  L  S  Y  R  L  C  *  L  Y

15781  ACATTTGTTAATGAGTATTATGAATTTTATGTAAGCATTTTAGTATGATGATTTTGAGT   15840
        T  F  V  N  E  Y  Y  E  F  L  C  K  H  F  S  M  M  I  L  S
         H  L  L  M  S  I  M  N  F  Y  V  S  I  L  V  *  *  F  *  V
          I  C  *  *  V  L  *  I  F  M  *  A  F  *  Y  D  D  F  E  *

15841  GATGATGGTGTTGTCTGTTATAACTCTGATTATGCTAGTAAGGGTTATATAGCTAATATA  15900
        D  D  G  V  V  C  Y  N  S  D  Y  A  S  K  G  Y  I  A  N  I
         M  M  V  L  S  V  I  T  L  I  M  L  V  R  V  I  *  L  I  *
          *  W  C  C  L  L  *  L  *  L  C  *  *  G  L  Y  S  *  Y  K

15901  AGTGTTTTTCAACAAGTTTTGTACTATCAGAATAATGTCTTTATGTCTGAATCTAAATGT  15960
        S  V  F  Q  Q  V  L  Y  Y  Q  N  N  V  F  M  S  E  S  K  C
         V  F  F  N  K  F  C  T  I  R  I  M  S  L  C  L  N  L  N  V
          C  F  S  T  S  F  V  L  S  E  *  C  L  Y  V  *  I  *  M  L

15961  TGGGTTGAAAATGATATTACTAATGGTCCTCATGAATTTTGTTCCCAACATACTATGTTA  16020
        W  V  E  N  D  I  T  N  G  P  H  E  F  C  S  Q  H  T  M  L
         G  L  K  M  I  L  L  M  V  L  M  N  F  V  P  N  I  L  C  *
          G  *  K  *  Y  Y  *  W  S  S  *  I  L  F  P  T  Y  Y  V  S

16021  GTTAAGATAGATGGTGATTATGTTTATTTACCATATCCAGATCCTTCTAGAATTTTAGGA  16080
        V  K  I  D  G  D  Y  V  Y  L  P  Y  P  D  P  S  R  I  L  G
         L  R  *  M  V  I  M  F  I  Y  H  I  Q  I  L  L  E  F  *  E
          *  D  R  W  *  L  C  L  F  T  I  S  R  S  F  *  N  F  R  S

16081  GCTGGTTGTTTTGTTGATGATTTATTGAAGACTGACAGTGTTCTTTTGATAGAGCGCTTT  16140
        A  G  C  F  V  D  D  L  L  K  T  D  S  V  L  L  I  E  R  F
         L  V  V  L  L  M  I  Y  *  R  L  T  V  F  F  *  *  S  A  L
          W  L  F  C  *  *  F  I  E  D  *  Q  C  S  F  D  R  A  L  C

16141  GTAAGTCTAGCTATAGATGCTTACCCTTTAGTACATCATGAAAATGAAGAATACCAAAAA  16200
        V  S  L  A  I  D  A  Y  P  L  V  H  H  E  N  E  E  Y  Q  K
         *  V  *  L  *  M  L  T  L  *  Y  I  M  K  M  K  N  T  K  K
          K  S  S  Y  R  C  L  P  F  S  T  S  *  K  *  R  I  P  K  S
```

FIG. 2 CONT'D

```
16201  GTCTTTCGTGTATATTTAGAATATATAAAAAAACTGTATAATGATCTTGGTACTCAGATC  16260
        V  F  R  V  Y  L  E  Y  I  K  K  L  Y  N  D  L  G  T  Q  I
         S  F  V  Y  I  *  N  I  *  K  N  C  I  M  I  L  V  L  R  S
          L  S  C  I  F  R  I  Y  K  K  T  V  *  *  S  W  Y  S  D  L

16261  TTAGATAGTTATAGTGTTATTTTAAGTACTTGTGATGGTTTAAAGTTTACTGAAGAATCA  16320
        L  D  S  Y  S  V  I  L  S  T  C  D  G  L  K  F  T  E  E  S
         *  I  V  I  V  L  F  *  V  L  V  M  V  *  S  L  L  K  N  H
          R  *  L  *  C  Y  F  K  Y  L  *  W  F  K  V  Y  *  R  I  I

16321  TTTTACAAGAATATGTATTTAAAAAGTGCCGTGATGCAGAGTGTAGGTGCATGCGTTGTT  16380
        F  Y  K  N  M  Y  L  K  S  A  V  M  Q  S  V  G  A  C  V  V
         F  T  R  I  C  I  *  K  V  P  *  C  R  V  *  V  H  A  L  F
          L  Q  E  Y  V  F  K  K  C  R  D  A  E  C  R  C  M  R  C  L

16381  TGTTCATCACAAACTTCTTTGCGTTGTGGCAGTTGTATACGTAAGCCTTTGTTATGTTGT  16440
        C  S  S  Q  T  S  L  R  C  G  S  C  I  R  K  P  L  L  C  C
         V  H  H  K  L  L  C  V  V  A  V  V  Y  V  S  L  C  Y  V  V
          F  I  T  N  F  F  A  L  W  Q  L  Y  T  *  A  F  V  M  L  *

16441  AAATGTTGTTATGACCATGTTATGGCAACTAATCATAAATATGTTTTGAGTGTCTCACCT  16500
        K  C  C  Y  D  H  V  M  A  T  N  H  K  Y  V  L  S  V  S  P
         N  V  V  M  T  M  L  W  Q  L  I  I  N  M  F  *  V  S  H  L
          M  L  L  *  P  C  Y  G  N  *  S  *  I  C  F  E  C  L  T  L

16501  TACGTTTGTAATGCACCTAACTGTGATGTGAGTGATGTCACCAAATTATATTTGGGCGGT  16560
        Y  V  C  N  A  P  N  C  D  V  S  D  V  T  K  L  Y  L  G  G
         T  F  V  M  H  L  T  V  M  *  V  M  S  P  N  Y  I  W  A  V
          R  L  *  C  T  *  L  *  C  E  *  C  H  Q  I  I  F  G  R  Y

16561  ATGTCTTACTATTGTGAAAACCATAAACCCCATTATTCATTTAAGTTAGTTATGAATGGT  16620
        M  S  Y  Y  C  E  N  H  K  P  H  Y  S  F  K  L  V  M  N  G
         C  L  T  I  V  K  T  I  N  P  I  I  H  L  S  *  L  *  M  V
          V  L  L  L  *  K  P  *  T  P  L  F  I  *  V  S  Y  E  W  Y

16621  ATGGTCTTTGGTTTGTATAAACAATCTTGCACGGGTTCACCTTATATAGATGATTTTAAT  16680
        M  V  F  G  L  Y  K  Q  S  C  T  G  S  P  Y  I  D  D  F  N
         W  S  L  V  C  I  N  N  L  A  R  V  H  L  I  *  M  I  L  I
          G  L  W  F  V  *  T  I  L  H  G  F  T  L  Y  R  *  F  *  *

16681  AAGATAGCTAGTTGTAAATGGACAGAAGTTGATGATTATGTTCTGGCAAATGAGTGTATT  16740
        K  I  A  S  C  K  W  T  E  V  D  D  Y  V  L  A  N  E  C  I
         R  *  L  V  V  N  G  Q  K  L  M  I  M  F  W  Q  M  S  V  L
          D  S  *  L  *  M  D  R  S  *  *  L  C  S  G  K  *  V  Y  *
```

FIG. 2 CONT'D

```
16741   GAACGTTTAAAGTTATTTGCTGCAGAAACTCAAAAGGCAACTGAAGAGGCTTTTAAACAA   16800
         E  R  L  K  L  F  A  A  E  T  Q  K  A  T  E  E  A  F  K  Q
        N  V  *  S  Y  L  L  Q  K  L  K  R  Q  L  K  R  L  L  N  K
       T  F  K  V  I  C  C  R  N  S  K  G  N  *  R  G  F  *  T  K

16801   AGCTATGCTTCTGCTACCATTCAAGAGATTGTTAGTGATAGAGAAGTTATTTGTGTTGG   16860
         S  Y  A  S  A  T  I  Q  E  I  V  S  D  R  E  V  I  L  C  W
        A  M  L  L  L  P  F  K  R  L  L  V  I  E  K  L  F  C  V  G
       L  C  F  C  Y  H  S  R  D  C  *  *  *  R  S  Y  F  V  L  G

16861   GAGACAGGTAAAGTTAAACCACCACTTAATAAAAATTATGTTTTCACAGGCTACCATTTT   16920
         E  T  G  K  V  K  P  P  L  N  K  N  Y  V  F  T  G  Y  H  F
        R  Q  V  K  L  N  H  H  L  I  K  I  M  F  S  Q  A  T  I  L
       D  R  *  S  *  T  T  T  *  *  K  L  C  F  H  R  L  P  F  Y

16921   ACTAGTACTGGTAAGACAGTTTTAGGTGAGTATGTTTTTGATAAAAGTGAATTAACTAAC   16980
         T  S  T  G  K  T  V  L  G  E  Y  V  F  D  K  S  E  L  T  N
        L  V  L  V  R  Q  F  *  V  S  M  F  L  I  K  V  N  *  L  T
       *  Y  W  *  D  S  F  R  *  V  C  F  *  *  K  *  I  N  *  R

16981   GGTGTGTATTACCGCGCTACAACTACTTATAAACTTTCTATAGGTGATGTTTTTGTTTTA   17040
         G  V  Y  Y  R  A  T  T  T  Y  K  L  S  I  G  D  V  F  V  L
        V  C  I  T  A  L  Q  L  L  I  N  F  L  *  V  M  F  L  F  *
       C  V  L  P  R  Y  N  Y  L  *  T  F  Y  R  *  C  F  C  F  N

17041   ACATCACATTCTGTAGCTAGTTTAAGTGCACCTACACTTGTCCCACAAGAGAACTATGCT   17100
         T  S  H  S  V  A  S  L  S  A  P  T  L  V  P  Q  E  N  Y  A
        H  H  I  L  *  L  V  *  V  H  L  H  L  S  H  K  R  T  M  L
       I  T  F  C  S  *  F  K  C  T  Y  T  C  P  T  R  E  L  C  *

17101   AGTATAAGATTTTCTAGTGTTTATAGTGTTCCATTGGTGTTTCAAAATAATGTTGCTAAT   17160
         S  I  R  F  S  S  V  Y  S  V  P  L  V  F  Q  N  N  V  A  N
        V  *  D  F  L  V  F  I  V  F  H  W  C  F  K  I  M  L  L  I
       Y  K  I  F  *  C  L  *  C  S  I  G  V  S  K  *  C  C  *  L

17161   TATCAGCACATTGGAATGAAACGTTATTGCACTGTTCAAGGTCCCCCTGGTACGGGAAAG   17220
         Y  Q  H  I  G  M  K  R  Y  C  T  V  Q  G  P  P  G  T  G  K
        I  S  T  L  E  *  N  V  I  A  L  F  K  V  P  L  V  R  E  S
       S  A  H  W  N  E  T  L  L  H  C  S  R  S  P  W  Y  G  K  V

17221   TCTCATCTTGCTATAGGTCTAGCTGTTTATTACTACACAGCACGTGTAGTTTATACTGCT   17280
         S  H  L  A  I  G  L  A  V  Y  Y  Y  T  A  R  V  V  Y  T  A
        L  I  L  L  *  V  *  L  F  I  T  T  Q  H  V  *  F  I  L  L
       S  S  C  Y  R  S  S  C  L  L  L  H  S  T  C  S  L  Y  C  C
```

FIG. 2 CONT'D

```
17281  GCTAGTCATGCTGCTGTAGATGCATTGTGTGAAAAAGCTTATAAGTTTTTAAATATTAAC  17340
        A  S  H  A  A  V  D  A  L  C  E  K  A  Y  K  F  L  N  I  N
       L  V  M  L  L  *  M  H  C  V  K  K  L  I  S  F  *  I  L  T
         *  S  C  C  C  R  C  I  V  *  K  S  L  *  V  F  K  Y  *  R

17341  GATTGTACACGTATTATTCCTGCTAAAGTTCGTGTAGATTGTTATGATAAGTTTAAAATT  17400
        D  C  T  R  I  I  P  A  K  V  R  V  D  C  Y  D  K  F  K  I
       I  V  H  V  L  F  L  L  K  F  V  *  I  V  M  I  S  L  K  L
         L  Y  T  Y  Y  S  C  *  S  S  C  R  L  L  *  *  V  *  N  *

17401  AATGATACCACTTGTAAGTATGTTTTTACCACAATAAATGCATTACCAGAGTTGGTTACA  17460
        N  D  T  T  C  K  Y  V  F  T  T  I  N  A  L  P  E  L  V  T
       M  I  P  L  V  S  M  F  L  P  Q  *  M  H  Y  Q  S  W  L  Q
         *  Y  H  L  *  V  C  F  Y  H  N  K  C  I  T  R  V  G  Y  R

17461  GATATTGTTGTTGTTGATGAAGTTAGTATGCTTACTAATTATGAATTGTCTGTTATAAAT  17520
        D  I  V  V  V  D  E  V  S  M  L  T  N  Y  E  L  S  V  I  N
       I  L  L  L  L  M  K  L  V  C  L  L  I  M  N  C  L  L  *  M
         Y  C  C  C  *  *  S  *  Y  A  Y  *  L  *  I  V  C  Y  K  C

17521  GCTCGTATTAAAGCTAAACATTATGTATATATTGGAGATCCTGCTCAATTACCTGCACCA  17580
        A  R  I  K  A  K  H  Y  V  V  Y  I  G  D  P  A  Q  L  P  A  P
       L  V  L  K  L  N  I  M  Y  I  L  E  I  L  L  N  Y  L  H  H
         S  Y  *  S  *  T  L  C  I  Y  W  R  S  C  S  I  T  C  T  T

17581  CGTGTGCTGTTGAGCAAGGGTTCTTTAGAACCTAGGCACTTCAATTCTATTACTAAAATA  17640
        R  V  L  L  S  K  G  S  L  E  P  R  H  F  N  S  I  T  K  I
       V  C  C  *  A  R  V  L  *  N  L  G  T  S  I  L  L  L  K  *
         C  A  V  E  Q  G  F  F  R  T  *  A  L  Q  F  Y  Y  *  N  N

17641  ATGTGTTGTTTAGGTCCTGATATCTTTTTGGGAAATTGTTATAGGTGTCCTAAAGAAATT  17700
        M  C  C  L  G  P  D  I  F  L  G  N  C  Y  R  C  P  K  E  I
       C  V  V  *  V  L  I  S  F  W  E  I  V  I  G  V  L  K  K  L
         V  L  F  R  S  *  Y  L  F  G  K  L  L  *  V  S  *  R  N  C

17701  GTAGAAACTGTTTCAGCATTGGTTTATGATAATAAACTCAAGGCTAAAAATGATAATAGT  17760
        V  E  T  V  S  A  L  V  Y  D  N  K  L  K  A  K  N  D  N  S
       *  K  L  F  Q  H  W  F  M  I  I  N  S  R  L  K  M  I  I  V
         R  N  C  F  S  I  G  L  *  *  *  T  Q  G  *  K  *  *  *  F

17761  TCATTATGTTTTAAAGTATATTTTAAGGGACAGACAACACATGAGAGTTCAAGTGCTGTA  17820
        S  L  C  F  K  V  Y  F  K  G  Q  T  T  H  E  S  S  A  V
       H  Y  V  L  K  Y  I  L  R  D  R  Q  H  M  R  V  Q  V  L  *
         I  M  F  *  S  I  F  *  G  T  D  N  T  *  E  F  K  C  C  K
```

FIG. 2 CONT'D

```
17821  AATATTCAACAGATATATCTAATTAGTAAATTTTAAAAGCTAATCCAGTTTGGAATAGT  17880
        N  I  Q  Q  I  Y  L  I  S  K  F  L  K  A  N  P  V  W  N  S
         I  F  N  R  Y  I  *  L  V  N  F  *  K  L  I  Q  F  G  I  V
          Y  S  T  D  I  S  N  *  *  I  F  K  S  *  S  S  L  E  *  C

17881  GCTGTTTTTATTAGTCCTTATAATAGTCAGAATTATGTTGCTAAGCGTGTTTTAGGTGTT  17940
        A  V  F  I  S  P  Y  N  S  Q  N  Y  V  A  K  R  V  L  G  V
         L  F  L  L  V  L  I  I  V  R  I  M  L  L  S  V  F  *  V  F
          C  F  Y  *  S  L  *  *  S  E  L  C  C  *  A  C  F  R  C  S

17941  CAAACACAAACTGTAGATTCTGCTCAAGGTTCGGAATATGATTATGTTATATATTCACAA  18000
        Q  T  Q  T  V  D  S  A  Q  G  S  E  Y  D  Y  V  I  Y  S  Q
         K  H  K  L  *  I  L  L  K  V  R  N  M  I  M  L  Y  I  H  K
          N  T  N  C  R  F  C  S  R  F  G  I  *  L  C  Y  I  F  T  N

18001  ACAGCAGAAACAGCCCATTCTGTTAATGTTAATCGATTTAATGTTGCCATAACTAGAGCC  18060
        T  A  E  T  A  H  S  V  N  V  N  R  F  N  V  A  I  T  R  A
         Q  Q  K  Q  P  I  L  L  M  L  I  D  L  M  L  P  *  L  E  P
          S  R  N  S  P  F  C  *  C  *  S  I  *  C  C  H  N  *  S  Q

18061  AAGAAGGGCATTTTTTGTGTTATGAGTAATATGCAATTATTTGAATCTCTTAATTTTATT  18120
        K  K  G  I  F  C  V  M  S  N  M  Q  L  F  E  S  L  N  F  I
         R  R  A  F  F  V  L  *  V  I  C  N  Y  L  N  L  L  I  L  L
          E  G  H  F  L  C  Y  E  *  Y  A  I  I  *  I  S  *  F  Y  Y

18121  ACTCTACCTTTAGATAAAATTCAAAATCAAACTTTACCTCGTTTGCATTGCACAACTAAT  18180
        T  L  P  L  D  K  I  Q  N  Q  T  L  P  R  L  H  C  T  T  N
         L  Y  L  *  I  K  F  K  I  K  L  Y  L  V  C  I  A  Q  L  I
          S  T  F  R  *  N  S  K  S  N  F  T  S  F  A  L  H  N  *  S

18181  CTTTTTAAAGATTGTAGTAAAAGTTGCTTAGGTTATCATCCAGCGCATGCCCCCTCATTT  18240
        L  F  K  D  C  S  K  S  C  L  G  Y  H  P  A  H  A  P  S  F
         F  L  K  I  V  V  K  V  A  *  V  I  I  Q  R  M  P  P  H  F
          F  *  R  L  *  *  K  L  L  R  L  S  S  S  A  C  P  L  I  F

18241  TTAGCAGTTGATGATAAATATAAGGTTAATGAAAATTTGGCTGTAAATTTAAATATTTGT  18300
        L  A  V  D  D  K  Y  K  V  N  E  N  L  A  V  N  L  N  I  C
         *  Q  L  M  I  N  I  R  L  M  K  I  W  L  *  I  *  I  F  V
          S  S  *  *  *  I  *  G  *  *  K  F  G  C  K  F  K  Y  L  *

18301  GAACCTGTTTTAACATATTCTCGTTTAATATCTCTTATGGGTTTTAAATTAGATTTGACT  18360
        E  P  V  L  T  Y  S  R  L  I  S  L  M  G  F  K  L  D  L  T
         N  L  F  *  H  I  L  V  *  Y  L  L  W  V  L  N  *  I  *  L
          T  C  F  N  I  F  S  F  N  I  S  Y  G  F  *  I  R  F  D  S
```

FIG. 2 CONT'D

```
18361   CTTGATGGTTATTCTAAATTGTTTATTACTAAAGATGAAGCCATTAAACGTGTTAGAGGT   18420
        L  D  G  Y  S  K  L  F  I  T  K  D  E  A  I  K  R  V  R  G
         L  M  V  I  L  N  C  L  L  L  K  M  K  P  L  N  V  L  E  V
          *  W  L  F  *  I  V  Y  Y  *  R  *  S  H  *  T  C  *  R  L

18421   TGGGTTGGTTTTGATGTTGAGGGCGCTCATGCTACTCGCGAAAACATTGGAACAAACTTT   18480
        W  V  G  F  D  V  E  G  A  H  A  T  R  E  N  I  G  T  N  F
         G  L  V  L  M  L  R  A  L  M  L  L  A  K  T  L  E  Q  T  F
          G  W  F  *  C  *  G  R  S  C  Y  S  R  K  H  W  N  K  L  S

18481   CCACTGCAAATAGGTTTTTCAACTGGTGTGGATTTTGTAGTTGAAGCTACTGGCTTATTT   18540
        P  L  Q  I  G  F  S  T  G  V  D  F  V  V  E  A  T  G  L  F
         H  C  K  *  V  F  Q  L  V  W  I  L  *  L  K  L  L  A  Y  L
          T  A  N  R  F  F  N  W  C  G  F  C  S  *  S  Y  W  L  I  C

18541   GCTGAGAGAGATTGTTATACTTTTAAAAAAACTGTAGCTAAAGCTCCTCCTGGTGAAAAA   18600
        A  E  R  D  C  Y  T  F  K  K  T  V  A  K  A  P  P  G  E  K
         L  R  E  I  V  I  L  L  K  K  L  *  L  K  L  L  L  V  K  N
          *  E  R  L  L  Y  F  *  K  N  C  S  *  S  S  S  W  *  K  I

18601   TTTAAACATTTAATACCCCTTATGTCAAAAGGTCAAAAGTGGGATATTGTTAGAATTAGA   18660
        F  K  H  L  I  P  L  M  S  K  G  Q  K  W  D  I  V  R  I  R
         L  N  I  *  Y  P  L  C  Q  K  V  K  S  G  I  L  L  E  L  E
          *  T  F  N  T  P  Y  V  K  R  S  K  V  G  Y  C  *  N  *  N

18661   ATTGTTCAAATGTTATCTGATTATCTTTTAGACCTTTCTGATAGTGTAGTATTTATTACT   18720
        I  V  Q  M  L  S  D  Y  L  L  D  L  S  D  S  V  V  F  I  T
         L  F  K  C  Y  L  I  I  F  *  T  F  L  I  V  *  Y  L  L  L
          C  S  N  V  I  *  L  S  F  R  P  F  *  *  C  S  I  Y  Y  L

18721   TGGTCTGCCAGTTTTGAACTTACTTGTTTAAGGTATTTTGCTAAATTAGGCAGAGAGCTT   18780
        W  S  A  S  F  E  L  T  C  L  R  Y  F  A  K  L  G  R  E  L
         G  L  P  V  L  N  L  L  V  *  G  I  L  L  N  *  A  E  S  L
          V  C  Q  F  *  T  Y  L  F  K  V  F  C  *  I  R  Q  R  A  *

18781   AATTGTAATGTGTGTTCTAATCGTGCTACATGCTACAATTCTAGAACTGGTTATTATGGT   18840
        N  C  N  V  C  S  N  R  A  T  C  Y  N  S  R  T  G  Y  Y  G
         I  V  M  C  V  L  I  V  L  H  A  T  I  L  E  L  V  I  M  V
          L  *  C  V  F  *  S  C  Y  M  L  Q  F  *  N  W  L  L  W  L

18841   TGTTGGCGCCATAGTTATACTTGTGATTATGTGTATAATCCACTTATTGTAGATATACAA   18900
        C  W  R  H  S  Y  T  C  D  Y  V  Y  N  P  L  I  V  D  I  Q
         V  G  A  I  V  I  L  V  I  M  C  I  I  H  L  L  *  I  Y  N
          L  A  P  *  L  Y  L  *  L  C  V  *  S  T  Y  C  R  Y  T  T
```

FIG. 2 CONT'D

| | | |
|---|---|---|
| 18901 | CAGTGGGGTTATACAGGTTCTTTAACTAGTAATCACGATATAATTTGTAATGTACATAAA | 18960 |
| | Q W G Y T G S L T S N H D I I C N V H K | |
| | S G V I Q V L * L V I T I * F V M Y I K | |
| | V G L Y R F F N * * S R Y N L * C T * R | |
| 18961 | GGTGCACATGTTGCGTCAGCTGATGCAATTATGACTCGTTGTTTAGCAATCTATGATTGT | 19020 |
| | G A H V A S A D A I M T R C L A I Y D C | |
| | V H M L R Q L M Q L * L V V * Q S M I V | |
| | C T C C V S * C N Y D S L F S N L * L F | |
| 19021 | TTTTGTAAATCTGTTAATTGGAATTTAGAGTATCCAATAATTTCTAATGAGGTCAGTATA | 19080 |
| | F C K S V N W N L E Y P I I S N E V S I | |
| | F V N L L I G I * S I Q * F L M R S V * | |
| | L * I C * L E F R V S N N F * * G Q Y K | |
| 19081 | AATACATCTTGTAGGTTATTGCAGCGTGTCATGCTTAAAGCTGCCATGCTATGTAATAGA | 19140 |
| | N T S C R L L Q R V M L K A A M L C N R | |
| | I H L V G Y C S V S C L K L P C Y V I D | |
| | Y I L * V I A A C H A * S C H A M * * I | |
| 19141 | TACAACTTATGTTATGACATAGGCAATCCTAAAGGTTTAGCTTGTGTCAAAGATTATGAA | 19200 |
| | Y N L C Y D I G N P K G L A C V K D Y E | |
| | T T Y V M T * A I L K V * L V S K I M N | |
| | Q L M L * H R Q S * R F S L C Q R L * I | |
| 19201 | TTTAAATTTTATGATGCTTTTCCTGTAGCCAAGTCTGTTAAACAGTTATTTTATGTCTAT | 19260 |
| | F K F Y D A F P V A K S V K Q L F Y V Y | |
| | L N F M M L F L * P S L L N S Y F M S M | |
| | * I L * C F S C S Q V C * T V I L C L * | |
| 19261 | GATGTGCATAAAGATAATTTTAAAGATGGTTTATGTATGTTTTGGAATTGTAATGTTGAT | 19320 |
| | D V H K D N F K D G L C M F W N C N V D | |
| | M C I K I I L K M V Y V C F G I V M L I | |
| | C A * R * F * R W F M Y V L E L * C * * | |
| 19321 | AAATATCCATCTAATTCAATTGTTTGTAGATTTGACACTCGAGTGTTAAATAAATTAAAC | 19380 |
| | K Y P S N S I V C R F D T R V L N K L N | |
| | N I H L I Q L F V D L T L E C * I N * T | |
| | I S I * F N C L * I * H S S V K * I K P | |
| 19381 | CTTCCTGGATGTAATGGTGGTAGTTTGTATGTTAATAAACATGCATTCCATACTAATCCT | 19440 |
| | L P G C N G G S L Y V N K H A F H T N P | |
| | F L D V M V V V C M L I N M H S I L I L | |
| | S W M * W W * F V C * * T C I P Y * S F | |

FIG. 2 CONT'D

```
19441  TTTACTAGAACTGTTTTTGAAAATCTTAAGCCTATGCCTTTTTTCTATTATTCAGATACG  19500
         F  T  R  T  V  F  E  N  L  K  P  M  P  F  F  Y  Y  S  D  T
        L  L  E  L  F  L  K  I  L  S  L  C  L  F  S  I  I  Q  I  R
          Y  *  N  C  F  *  K  S  *  A  Y  A  F  F  L  L  F  R  Y  A

19501  CCTTGTGTGTACGTAGATGGTTTAGAATCTAAACAAGTTGATTACGTTCCTTTAAGAAGC  19560
         P  C  V  Y  V  D  G  L  E  S  K  Q  V  D  Y  V  P  L  R  S
        L  V  C  T  *  M  V  *  N  L  N  K  L  I  T  F  L  *  E  A
          L  C  V  R  R  W  F  R  I  *  T  S  *  L  R  S  F  K  K  R

19561  GCCACTTGTATCACACGGTGTAATCTAGGTGGAGCTGTTTGTTCAAAGCATGCTGAAGAA  19620
         A  T  C  I  T  R  C  N  L  G  G  A  V  C  S  K  H  A  E  E
        P  L  V  S  H  G  V  I  *  V  E  L  F  V  Q  S  M  L  K  N
          H  L  Y  H  T  V  *  S  R  W  S  C  L  F  K  A  C  *  R  I

19621  TATTGTAACTACCTTGAGTCTTATAATATAGTTACTACAGCAGGCTTTACTTTTTGGGTT  19680
         Y  C  N  Y  L  E  S  Y  N  I  V  T  T  A  G  F  T  F  W  V
        I  V  T  T  L  S  L  I  I  *  L  L  Q  Q  A  L  L  F  G  F
          L  *  L  P  *  V  L  *  Y  S  Y  Y  S  R  L  Y  F  L  G  L

19681  TATAAGAATTTTGATTTTTATAATTTATGGAACACTTTTACTACGTTACAGAGTTTAGAA  19740
         Y  K  N  F  D  F  Y  N  L  W  N  T  F  T  T  L  Q  S  L  E
        I  R  I  L  I  F  I  I  Y  G  T  L  L  L  R  Y  R  V  *  K
          *  E  F  *  F  L  *  F  M  E  H  F  Y  Y  V  T  E  F  R  K

19741  AACGTAATATATAACTTGGTTAATGTTGGTCATTATGATGGACGTACAGGTGAATTACCT  19800
         N  V  I  Y  N  L  V  N  V  G  H  Y  D  G  R  T  G  E  L  P
        T  *  Y  I  T  W  L  M  L  V  I  M  M  D  V  Q  V  N  Y  L
          R  N  I  *  L  G  *  C  W  S  L  *  W  T  Y  R  *  I  T  L

19801  TGTGCTATTATGAATGACAAAGTTGTTGTTAAGATTAATAATGTAGATACTGTTATTTTT  19860
         C  A  I  M  N  D  K  V  V  V  K  I  N  N  V  D  T  V  I  F
        V  L  L  *  M  T  K  L  L  L  R  L  I  M  *  I  L  L  F  L
          C  Y  Y  E  *  Q  S  C  C  *  D  *  *  C  R  Y  C  Y  F  *

19861  AAAAATAATACATCATTTCCTACTAATATAGCTGTTGAATTGTTTACAAAACGTAGTATC  19920
         K  N  N  T  S  F  P  T  N  I  A  V  E  L  F  T  K  R  S  I
        K  I  I  H  H  F  L  L  I  *  L  L  N  C  L  Q  N  V  V  S
          K  *  Y  I  I  S  Y  *  Y  S  C  *  I  V  Y  K  T  *  Y  P

19921  CGGCACCACCCTGAACTTAAGATTCTTAGAAATTTGAACATTGATATTTGTTGGAAGCAT  19980
         R  H  H  P  E  L  K  I  L  R  N  L  N  I  D  I  C  W  K  H
        G  T  T  L  N  L  R  F  L  E  I  *  T  L  I  F  V  G  S  M
          A  P  P  *  T  *  D  S  *  K  F  E  H  *  Y  L  L  E  A  C
```

FIG. 2 CONT'D

| | | |
|---|---|---|
| 19981 | GTCCTGTGGGATTATGTTAAAGATAGTTTGTTTTGTAGTTCCACTTATGGTGTTTGTAAA | 20040 |
| | V L W D Y V K D S L F C S S T Y G V C K | |
| | S C G I M L K I V C F V V P L M V F V N | |
| | P V G L C * R * F V L * F H L W C L * I | |
| | | |
| 20041 | TACACAGATTTGAAGTTCATCGAAAATTTGAATATACTTTTTGATGGTCGTGACACTGGC | 20100 |
| | Y T D L K F I E N L N I L F D G R D T G | |
| | T Q I * S S S K I * I Y F L M V V T L A | |
| | H R F E V H R K F E Y T F * W S * H W R | |
| | | |
| 20101 | GCTTTAGAAGCTTTTAGAAAAGCAAGAAATGGTGTTTTTATTAGTACTGAAAAATTAAGT | 20160 |
| | A L E A F R K A R N G V F I S T E K L S | |
| | L * K L L E K Q E M V F L L V L K N * V | |
| | F R S F * K S K K W C F Y * Y * K I K * | |
| | | |
| 20161 | AGGTTATCAATGATTAAAGGTCCGCAACGAGCTGATTTAAATGGTGTGATTGTGGATAAA | 20220 |
| | R L S M I K G P Q R A D L N G V I V D K | |
| | G Y Q * L K V R N E L I * M V * L W I K | |
| | V I N D * R S A T S * F K W C D C G * S | |
| | | |
| 20221 | GTTGGAGAACTCAAAGTTGAGTTTTGGTTCGCTATGAGAAAAGATGGTGACGATGTTATC | 20280 |
| | V G E L K V E F W F A M R K D G D D V I | |
| | L E N S K L S F G S L * E K M V T M L S | |
| | W R T Q S * V L V R Y E K R W * R C Y L | |
| | | |
| 20281 | TTCAGCCGAACAGACAGCCTATGCTCAAGCCATTACTGGAGCCCACAAGGTAATCTAGGT | 20340 |
| | F S R T D S L C S S H Y W S P Q G N L G | |
| | S A E Q T A Y A Q A I T G A H K V I * V | |
| | Q P N R Q P M L K P L L E P T R * S R W | |
| | | |
| 20341 | GGTAATTGCGCGGGTAATGTCATTGGTAATGATGCTCTAACACGTTTTACTATCTTTACT | 20400 |
| | G N C A G N V I G N D A L T R F T I F T | |
| | V I A R V M S L V M M L * H V L L S L L | |
| | * L R G * C H W * * C S N T F Y Y L Y S | |
| | | |
| 20401 | CAGAGTCGTGTATTGTCAAGTTTTGAACCTCGCTCAGATTTAGAACGGGATTTTATTGAT | 20460 |
| | Q S R V L S S F E P R S D L E R D F I D | |
| | R V V Y C Q V L N L A Q I * N G I L L I | |
| | E S C I V K F * T S L R F R T G F Y * Y | |
| | | |
| 20461 | ATGGATGATAATCTGTTTATTGCTAAATATGGTTTAGAAGACTATGCATTTGATCATATA | 20520 |
| | M D D N L F I A K Y G L E D Y A F D H I | |
| | W M I I C L L L N M V * K T M H L I I * | |
| | G * * S V Y C * I W F R R L C I * S Y S | |

FIG. 2 CONT'D

```
20521   GTTTATGGTAGTTTTAACCATAAAGTTATAGGAGGTTTGCATTTGCTTATAGGCTTATTT   20580
        V  Y  G  S  F  N  H  K  V  I  G  G  L  H  L  L  I  G  L  F
         F  M  V  V  L  T  I  K  L  *  E  V  C  I  C  L  *  A  Y  F
          L  W  *  F  *  P  *  S  Y  R  R  F  A  F  A  Y  R  L  I  S

20581   CGTAGGAAAAAAAAATCTAATTTGTTAATTCAAGAGTTTTTACAGTATGATTCTAGTATT   20640
        R  R  K  K  K  S  N  L  L  I  Q  E  F  L  Q  Y  D  S  S  I
         V  G  K  K  N  L  I  C  *  F  K  S  F  Y  S  M  I  L  V  F
          *  E  K  K  I  *  F  V  N  S  R  V  F  T  V  *  F  *  Y  S

20641   CATTCATATTTTATTACTGATCAGGAGTGTGGTAGTAGTAAGAGTGTTTGTACAGTTATT   20700
        H  S  Y  F  I  T  D  Q  E  C  G  S  S  K  S  V  C  T  V  I
         I  H  I  L  L  L  I  R  S  V  V  V  V  R  V  F  V  Q  L  L
          F  I  F  Y  Y  *  S  G  V  W  *  *  *  E  C  L  Y  S  Y  *

20701   GATTTATTATTAGATGATTTTGTTTCTATTGTTAAGTCATTAAATTTGAGTTGTGTTAGT   20760
        D  L  L  L  D  D  F  V  S  I  V  K  S  L  N  L  S  C  V  S
         I  Y  Y  *  M  I  L  F  L  L  L  S  H  *  I  *  V  V  L  V
          F  I  I  R  *  F  C  F  Y  C  *  V  I  K  F  E  L  C  *  *

20761   AAAGTTGTTAATATTAATGTTGATTTTAAGGATTTTCAATTTATGTTGTGGTGTAATGAT   20820
        K  V  V  N  I  N  V  D  F  K  D  F  Q  F  M  L  W  C  N  D
         K  L  L  I  L  M  L  I  L  R  I  F  N  L  C  C  G  V  M  I
          S  C  *  Y  *  C  *  F  *  G  F  S  I  Y  V  V  V  *  *  *

20821   AATAAAATTATGACTTTTTATCCTAAAATGCAAGCCACTAATGATTGGAAACCTGGCTAT   20880
        N  K  I  M  T  F  Y  P  K  M  Q  A  T  N  D  W  K  P  G  Y
         I  K  L  *  L  F  I  L  K  C  K  P  L  M  I  G  N  L  A  I
          *  N  Y  D  F  L  S  *  N  A  S  H  *  *  L  E  T  W  L  F

20881   TCTATGCCTGTTTTGTATAAGTATTTGAATGTTCCATTAGAGAGAGTCTCTTTATGGAAT   20940
        S  M  P  V  L  Y  K  Y  L  N  V  P  L  E  R  V  S  L  W  N
         L  C  L  F  C  I  S  I  *  M  F  H  *  R  E  S  L  Y  G  I
          Y  A  C  F  V  *  V  F  E  C  S  I  R  E  S  L  F  M  E  L

20941   TATGGTAAACCTATTAATTTGCCTACAGGCTGTATGATGAATGTTGCTAAGTACACTCAA   21000
        Y  G  K  P  I  N  L  P  T  G  C  M  M  N  V  A  K  Y  T  Q
         M  V  N  L  L  I  C  L  Q  A  V  *  *  M  L  L  S  T  L  N
          W  *  T  Y  *  F  A  Y  R  L  Y  D  E  C  C  *  V  H  S  I

21001   TTATGTCAGTATTTGAATACTACAACATTAGCTGTTCCTGTTAATATGCGTGTTTTACAT   21060
        L  C  Q  Y  L  N  T  T  T  L  A  V  P  V  N  M  R  V  L  H
         Y  V  S  I  *  I  L  Q  H  *  L  F  L  L  I  C  V  F  Y  I
          M  S  V  F  E  Y  Y  N  I  S  C  S  C  *  Y  A  C  F  T  F
```

FIG. 2 CONT'D

| | | |
|---|---|---|
| 21061 | TTAGGTGCAGGGTCTGATAAAGAAGTAGCTCCAGGTTCTGCTGTTTTAAGACAGTGGTTA | 21120 |

```
        L  G  A  G  S  D  K  E  V  A  P  G  S  A  V  L  R  Q  W  L
     *  V  Q  G  L  I  K  K  *  L  Q  V  L  L  F  *  D  S  G  Y
        R  C  R  V  *  *  R  S  S  S  R  F  C  C  F  K  T  V  V  T
```

| | | |
|---|---|---|
| 21121 | CCATCTGGTAGTATTCTTGTAGATAATGATTTAAACCCATTTGTTAGCGATAGTTTAGTT | 21180 |

```
        P  S  G  S  I  L  V  D  N  D  L  N  P  F  V  S  D  S  L  V
        H  L  V  V  F  L  *  I  M  I  *  T  H  L  L  A  I  V  *  L
        I  W  *  Y  S  C  R  *  *  F  K  P  I  C  *  R  *  F  S  Y
```

| | | |
|---|---|---|
| 21181 | ACTTATTTTGGAGATTGTATGACTTTACCATTTGATTGTCATTGGGATTTGATAATATCT | 21240 |

```
        T  Y  F  G  D  C  M  T  L  P  F  D  C  H  W  D  L  I  I  S
        L  I  L  E  I  V  *  L  Y  H  L  I  V  I  G  I  *  *  Y  L
        L  F  W  R  L  Y  D  F  T  I  *  L  S  L  G  F  D  N  I  *
```

| | | |
|---|---|---|
| 21241 | GATATGTATGATCCTCTTACTAAAAATATTGGTGATTATAATGTGAGTAAGGATGGGTTT | 21300 |

```
        D  M  Y  D  P  L  T  K  N  I  G  D  Y  N  V  S  K  D  G  F
        I  C  M  I  L  L  L  K  I  L  V  I  I  M  *  V  R  M  G  F
        Y  V  *  S  S  Y  *  K  Y  W  *  L  *  C  E  *  G  W  V  F
```

| | | |
|---|---|---|
| 21301 | TTTACTTACATTTGTCATTTAATTCGTGATAAATTATCTTTGGGTGGTAGTGTAGCTATA | 21360 |

```
        F  T  Y  I  C  H  L  I  R  D  K  L  S  L  G  G  S  V  A  I
        L  L  T  F  V  I  *  F  V  I  N  Y  L  W  V  V  V  *  L  *
        Y  L  H  L  S  F  N  S  *  *  I  I  F  G  W  *  C  S  Y  K
```

| | | |
|---|---|---|
| 21361 | AAAATTACAGAGTTTTCTTGGAATGCTGATTTATATAAATTAATGAGTTGTTTTGCATTT | 21420 |

```
        K  I  T  E  F  S  W  N  A  D  L  Y  K  L  M  S  C  F  A  F
        K  L  Q  S  F  L  G  M  L  I  Y  I  N  *  *  V  V  L  H  F
        N  Y  R  V  F  L  E  C  *  F  I  *  I  N  E  L  F  C  I  L
```

| | | |
|---|---|---|
| 21421 | TGGACAGTTTTTTGTACTAATGTAAATGCTTCTTCTAGTGAAGGGTTTTTAATAGGTATA | 21480 |

```
        W  T  V  F  C  T  N  V  N  A  S  S  S  E  G  F  L  I  G  I
        G  Q  F  F  V  L  M  *  M  L  L  L  V  K  G  F  *  *  V  *
        D  S  F  L  Y  *  C  K  C  F  F  *  *  R  V  F  N  R  Y  K
```

| | | |
|---|---|---|
| 21481 | AATTACCTGGGTAAATCTTCTTTTGAAATAGATGGCAATGTTATGCATGCTAACTATTTG | 21540 |

```
        N  Y  L  G  K  S  S  F  E  I  D  G  N  V  M  H  A  N  Y  L
        I  T  W  V  N  L  L  L  K  *  M  A  M  L  C  M  L  T  I  C
        L  P  G  *  I  F  F  *  N  R  W  Q  C  Y  A  C  *  L  F  V
```

| | | |
|---|---|---|
| 21541 | TTTTGGAGAAATAGTACAACATGGAATGGCGGTGCTTATAGTTTATTTGATATGACTAAA | 21600 |

```
        F  W  R  N  S  T  T  W  N  G  G  A  Y  S  L  F  D  M  T  K
        F  G  E  I  V  Q  H  G  M  A  V  L  I  V  Y  L  I  *  L  N
        L  E  K  *  Y  N  M  E  W  R  C  L  *  F  I  *  Y  D  *  I
```

FIG. 2 CONT'D

```
21601   TTTTCTTTGAAATTGGCTGGCACTGCTGTTGTTAATTTAAGACCAGATCAATTAAATGAT   21660
        F  S  L  K  L  A  G  T  A  V  V  N  L  R  P  D  Q  L  N  D
         F  L  *  N  W  L  A  L  L  L  L  I  *  D  Q  I  N  *  M  I
          F  F  E  I  G  W  H  C  C  C  *  F  K  T  R  S  I  K  *  F

21661   TTAGTTTATTCTCTTATTGAAAGAGGTAAATTATTAGTTCGCGATACGCGTAAAGAGATT   21720
        L  V  Y  S  L  I  E  R  G  K  L  L  V  R  D  T  R  K  E  I
         *  F  I  L  L  L  K  E  V  N  Y  *  F  A  I  R  V  K  R  F
          S  L  F  S  Y  *  K  R  *  I  I  S  S  R  Y  A  *  R  D  F

21721   TTTGTTGGTGATAGTCTTGTAAATACTTGTTAGATCTCATTAAATCTAAACTATGTTAAT   21780
        F  V  G  D  S  L  V  N  T  C  *  I  S  L  N  L  N  Y  V  N
         L  L  V  I  V  L  *  I  L  V  R  S  H  *  I  *  T  M  L  I
          C  W  *  *  S  C  K  Y  L  L  D  L  I  K  S  K  L  C  *  L

21781   TATTTTTTTATTTTTTTATTTCTGTTATGGTTTTAATGAACCTCTTAATGTTGTGTCTCA   21840
        Y  F  F  I  F  L  F  L  L  W  F  *  *  T  S  *  C  C  V  S
         I  F  L  F  F  Y  F  C  Y  G  F  N  E  P  L  N  V  V  S  H
          F  F  Y  F  F  I  S  V  M  V  L  M  N  L  L  M  L  C  L  I

21841   TTTAAACCATGACTGGTTTTTATTTGGTGATAGTCGTTCTGATTGTAACCATATTAATAA   21900
        F  K  P  *  L  V  F  I  W  *  *  S  F  *  L  *  P  Y  *  *
         L  N  H  D  W  F  L  F  G  D  S  R  S  D  C  N  H  I  N  N
          *  T  M  T  G  F  Y  L  V  I  V  V  L  I  V  T  I  L  I  I

21901   TTTAAAAATTAAAAATTTTGATTATTTGGATATTCACCCTAGTTTGTGCAACAATGGTAA   21960
        F  K  N  *  K  F  *  L  F  G  Y  S  P  *  F  V  Q  Q  W  *
         L  K  I  K  N  F  D  Y  L  D  I  H  P  S  L  C  N  N  G  K
          *  K  L  K  I  L  I  I  W  I  F  T  L  V  C  A  T  M  V  R

21961   GATTTCATCTAGTGCCGGTGATTCTATTTTTAAGAGTTTTCATTTCACTCGATTTTATAA   22020
        D  F  I  *  C  R  *  F  Y  F  *  E  F  S  F  H  S  I  L  *
         I  S  S  S  A  G  D  S  I  F  K  S  F  H  F  T  R  F  Y  N
          F  H  L  V  P  V  I  L  F  L  R  V  F  I  S  L  D  F  I  I

22021   TTACACTGGCGAAGGTGATCAAATTATTTTTTATGAGGGTGTTAATTTTAATCCTTATCA   22080
        L  H  W  R  R  *  S  N  Y  F  L  *  G  C  *  F  *  S  L  S
         Y  T  G  E  G  D  Q  I  I  F  Y  E  G  V  N  F  N  P  Y  H
          T  L  A  K  V  I  K  L  F  F  M  R  V  L  I  L  I  L  I  I

22081   TAGATTTAAGTGTTTTCCTAATGGTAGTAATGATGTATGGCTTCTTAACAAGGTAAGATT   22140
        *  I  *  V  F  S  *  W  *  *  *  C  M  A  S  *  Q  G  K  I
         R  F  K  C  F  P  N  G  S  N  D  V  W  L  L  N  K  V  R  F
          D  L  S  V  F  L  M  V  V  M  M  Y  G  F  L  T  R  *  D  F
```

FIG. 2 CONT'D

```
22141   TTATCGTGCCTTATATTCTAATATGGCCTTTTTCGTTATCTTACTTTTGTTGATATTCC   22200
         L  S  C  L  I  F  *  Y  G  L  F  S  L  S  Y  F  C  *  Y  S
          Y  R  A  L  Y  S  N  M  A  F  F  R  Y  L  T  F  V  D  I  P
           I  V  P  Y  I  L  I  W  P  F  F  V  I  L  L  L  I  F  L

22201   TTATAATGTTTCTCTTTCTAAGTTTAATTCTTGTAAAAGTGATATTTTATCACTTAACAA   22260
         L  *  C  F  S  F  *  V  *  F  L  *  K  *  Y  F  I  T  *  Q
          Y  N  V  S  L  S  K  F  N  S  C  K  S  D  I  L  S  L  N  N
           I  M  F  L  F  L  S  L  I  L  V  K  V  I  F  Y  H  L  T  I

22261   TCCTATTTTTATTAATTATTCTAAGGAAGTTTATTTTACTTTATTAGGTTGTTCTCTTTA   22320
         S  Y  F  Y  *  L  F  *  G  S  L  F  Y  F  I  R  L  F  S  L
          P  I  F  I  N  Y  S  K  E  V  Y  F  T  L  L  G  C  S  L  Y
           L  F  L  L  I  I  L  R  K  F  I  L  L  Y  *  V  V  L  F  I

22321   TTTAGTACCGCTTTGCCTTTTTAAATCTAACTTTAGTCAGTACTATTATAACATAGATAC   22380
         F  S  T  A  L  P  F  *  I  *  L  *  S  V  L  L  *  H  R  Y
          L  V  P  L  C  L  F  K  S  N  F  S  Q  Y  Y  Y  N  I  D  T
           *  Y  R  F  A  F  L  N  L  T  L  V  S  T  I  I  T  *  I  L

22381   TGGCTCTGTTTATGGTTTTTCTAATGTTGTTTATCCTGATTTAGACTGTATTTATATTTC   22440
         W  L  C  L  W  F  F  *  C  C  L  S  *  F  R  L  Y  L  Y  F
          G  S  V  Y  G  F  S  N  V  V  Y  P  D  L  D  C  I  Y  I  S
           A  L  F  M  V  F  L  M  L  F  I  L  I  *  T  V  F  I  F  L

22441   TCTTAAACCAGGTTCTTATAAAGTTTCCACCACTGCACCTTTTTTATCCTTACCTACTAA   22500
         S  *  T  R  F  L  *  S  F  H  H  C  T  F  F  I  L  T  Y  *
          L  K  P  G  S  Y  K  V  S  T  T  A  P  F  L  S  L  P  T  K
           L  N  Q  V  L  I  K  F  P  P  L  H  L  F  Y  P  Y  L  L  K

22501   AGCTCTCTGTTTTGATAAATCTAAACAATTTGTACCTGTACAGGTTGTTGATTCTAGATG   22560
         S  S  L  F  *  *  I  *  T  I  C  T  C  T  G  C  *  F  *  M
          A  L  C  F  D  K  S  K  Q  F  V  P  V  Q  V  V  D  S  R  W
           L  S  V  L  I  N  L  N  N  L  Y  L  Y  R  L  L  I  L  D  G

22561   GAACAACGAGCGTGCCTCAGATATTTCTTTATCTGTTGCATGTCAATTGCCATATTGTTA   22620
         E  Q  R  A  C  L  R  Y  F  F  I  C  C  M  S  I  A  I  L  L
          N  N  E  R  A  S  D  I  S  L  S  V  A  C  Q  L  P  Y  C  Y
           T  T  S  V  P  Q  I  F  L  Y  L  L  H  V  N  C  H  I  V  I

22621   TTTTCGCAATTCTTCTGCTAATTATGTTGGCAAGTATGATATTAACCACGGTGATAGTGG   22680
         F  S  Q  F  F  C  *  L  C  W  Q  V  *  Y  *  P  R  *  *  W
          F  R  N  S  S  A  N  Y  V  G  K  Y  D  I  N  H  G  D  S  G
           F  A  I  L  L  L  I  M  L  A  S  M  I  L  T  T  V  I  V  V
```

FIG. 2 CONT'D

```
22681   TTTTATTTCTATTTTATCTGGTCTTTTATATAATGTTTCTTGTATTTCATATTATGGTGT   22740
        F Y F Y F I W S F I * C F L Y F I L W C
          F I S I L S G L L Y N V S C I S Y Y G V
            L F L F Y L V F Y I M F L V F H I M V Y

22741   ATTTTTATATGATAATTTTACATCCATTTGGCCCTATTATTCTTTTGGTAGGTGTCCTAC   22800
        I F I * * F Y I H L A L L F F W * V S Y
          F L Y D N F T S I W P Y Y S F G R C P T
            F Y M I I L H P F G P I I L L V G V L H

22801   ATCTTCTATTATTAAACATCCAATTTGTGTTTATGATTTTTTGCCTATTATTTTACAAGG   22860
        I F Y Y * T S N L C L * F F A Y Y F T R
          S S I I K H P I C V Y D F L P I I L Q G
            L L L L N I Q F V F M I F C L L F Y K V

22861   TATTTTATTATGTTTAGCTTTACTTTTTGTTGTTTTTCTATTATTTTTGTTATATAACGA   22920
        Y F I M F S F T F C C F S I I F V I * R
          I L L C L A L L F V V F L L F L L Y N D
            F Y Y V * L Y F L L F F Y Y F C Y I T I

22921   TAAATCTCATTAAATCTAAACATGTTATTAATTATTTTTATTTTGCCTACAACATTAGCT   22980
        * I S L N L N M L L I I F I L P T T L A
          K S H * I * T C Y * L F L F C L Q H * L
            N L I K S K H V I N Y F Y F A Y N I S C

22981   GTTATAGGTGATTTTAATTGTACTAATTTTGCTATTAATGATTTAAACACCACAGTTCCT   23040
        V I G D F N C T N F A I N D L N T T V P
          L * V I L I V L I L L M I * T P Q F L
            Y R * F * L Y * F C Y * * F K H H S S S

23041   CGCATAAGTGAGTATGTTGTGGATGTTTCTTATGGTTTGGGTACATATTATATACTTGAT   23100
        R I S E Y V V D V S Y G L G T Y Y I L D
          A * V S M L W M F L M V W V H I I Y L I
            H K * V C C G C F L W F G Y I L Y T * S

23101   CGTGTTTATTTAAATACTACTATATTATTTACTGGTTATTTCCCTAAATCTGGTGCCAAT   23160
        R V Y L N T T I L F T G Y F P K S G A N
          V F I * I L L Y Y L L V I S L N L V P I
            C L F K Y Y Y I I Y W L F P * I W C Q F

23161   TTTAGGGATCTATCTTTAAAAGGTACTACATATTTGAGTACTCTTTGGTATCAGAAACCC   23220
        F R D L S L K G T T Y L S T L W Y Q K P
          L G I Y L * K V L H I * V L F G I R N P
            * G S I F K R Y Y I F E Y S L V S E T L
```

FIG. 2 CONT'D

| 23221 | TTTTTATCTGATTTTAATAATGGTATTTTTTCTAGAGTTAAGAATACTAAGTTGTATGTT | 23280 |
|---|---|---|
| | F L S D F N N G I F S R V K N T K L Y V | |
| | F Y L I L I M V F F L E L R I L S C M L | |
| | F I * F * * W Y F F * S * E Y * V V C * | |

| 23281 | AATAAACTTTGTATAGTGAGTTTAGTACTATAGTTATAGGTAGTGTTTTTATTAACAAC | 23340 |
|---|---|---|
| | N K T L Y S E F S T I V I G S V F I N N | |
| | I K L C I V S L V L * L * V V F L L T T | |
| | * N F V * * V * Y Y S Y R * C F Y * Q L | |

| 23341 | TCTTATACTATTGTTGTTCAACCTCATAATGGTGTTTTGGAGATTACAGCTTGTCAATAC | 23400 |
|---|---|---|
| | S Y T I V V Q P H N G V L E I T A C Q Y | |
| | L I L L L F N L I M V F W R L Q L V N T | |
| | L Y Y C C S T S * W C F G D Y S L S I H | |

| 23401 | ACTATGTGTGAGTATCCTCATACTATTTGTAAATCTAAAGGTAGTTCTCGTAATGAATCT | 23460 |
|---|---|---|
| | T M C E Y P H T I C K S K G S S R N E S | |
| | L C V S I L I L F V N L K V V L V M N L | |
| | Y V * V S S Y Y L * I * R * F S * * I L | |

| 23461 | TGGCATTTTGATAAATCTGAACCTTTGTGTCTGTTCAAGAAAAATTTTACTTATAATGTT | 23520 |
|---|---|---|
| | W H F D K S E P L C L F K K N F T Y N V | |
| | G I L I N L N L C V C S R K I L L I M F | |
| | A F * * I * T F V S V Q E K F Y L * C F | |

| 23521 | TCTACAGATTGGTTGTATTTTCATTTTTATCAAGAACGTGGCACTTTTTATGCTTATTAT | 23580 |
|---|---|---|
| | S T D W L Y F H F Y Q E R G T F Y A Y Y | |
| | L Q I G C I F I F I K N V A L F M L I M | |
| | Y R L V V F S F L S R T W H F L C L L C | |

| 23581 | GCTGATTCTGGCATGCCTACTACTTTTTTATTTAGTTTGTATCTTGGTACTCTTTTATCT | 23640 |
|---|---|---|
| | A D S G M P T T F L F S L Y L G T L L S | |
| | L I L A C L L L F Y L V C I L V L F Y L | |
| | * F W H A Y Y F F I * F V S W Y S F I S | |

| 23641 | CATTATTATGTTTTGCCTTTGACTTGTAATGCTATATCTTCTAATACTGATAATGAGACT | 23700 |
|---|---|---|
| | H Y Y V L P L T C N A I S S N T D N E T | |
| | I I M F C L * L V M L Y L L I L I M R L | |
| | L L C F A F D L * C Y I F * Y * * * D F | |

| 23701 | TTACAATATTGGGTCACACCTTTGTCTAAACGCCAATATCTTCTTAAATTTGACAACCGT | 23760 |
|---|---|---|
| | L Q Y W V T P L S K R Q Y L L K F D N R | |
| | Y N I G S H L C L N A N I F L N L T T V | |
| | T I L G H T F V * T P I S S * I * Q P W | |

FIG. 2 CONT'D

```
23761  GGTGTTATTACTAATGCTGTTGATTGTTCTAGTAGTTTCTTTAGCGAGATTCAATGTAAA  23820
        G  V  I  T  N  A  V  D  C  S  S  S  F  F  S  E  I  Q  C  K
         V  L  L  L  M  L  L  I  V  L  V  V  S  L  A  R  F  N  V  K
          C  Y  Y  *  C  C  *  L  F  *  *  F  L  *  R  D  S  M  *  N

23821  ACTAAATCTTTATTACCTAATACTGGTGTTTATGACTTATCTGGTTTTACTGTTAAGCCT  23880
        T  K  S  L  L  P  N  T  G  V  Y  D  L  S  G  F  T  V  K  P
         L  N  L  Y  Y  L  I  L  V  F  M  T  Y  L  V  L  L  L  S  L
          *  I  F  I  T  *  Y  W  C  L  *  L  I  W  F  Y  C  *  A  C

23881  GTTGCAACTGTACATCGTCGTATTCCTGATTTACCTGATTGTGACATTGATAAATGGCTT  23940
        V  A  T  V  H  R  R  I  P  D  L  P  D  C  D  I  D  K  W  L
         L  Q  L  Y  I  V  V  F  L  I  Y  L  I  V  T  L  I  N  G  L
          C  N  C  T  S  S  Y  S  *  F  T  *  L  *  H  *  *  M  A  *

23941  AACAATTTTAATGTACCCTCACCTCTTAATTGGGAACGTAAAATTTTTTCTAATTGCAAC  24000
        N  N  F  N  V  P  S  P  L  N  W  E  R  K  I  F  S  N  C  N
         T  I  L  M  Y  P  H  L  L  I  G  N  V  K  F  F  L  I  A  T
          Q  F  *  C  T  L  T  S  *  L  G  T  *  N  F  F  *  L  Q  L

24001  TTTAATTTGAGTACTTTGCTTCGTTTAGTTCATACTGATTCTTTTTCTTGTAATAATTTT  24060
        F  N  L  S  T  L  L  R  L  V  H  T  D  S  F  S  C  N  N  F
         L  I  *  V  L  C  F  V  *  F  I  L  I  L  F  L  V  I  I  L
          *  F  E  Y  F  A  S  F  S  S  Y  *  F  F  F  L  *  *  F  *

24061  GATGAATCTAAGATATATGGTAGTTGTTTTAAGAGTATTGTTTTAGATAAATTTGCCATA  24120
        D  E  S  K  I  Y  G  S  C  F  K  S  I  V  L  D  K  F  A  I
         M  N  L  R  Y  M  V  V  V  L  R  V  L  F  *  I  N  L  P  Y
          *  I  *  D  I  W  *  L  F  *  E  Y  C  F  R  *  I  C  H  T

24121  CCCAACTCCAGACGATCTGATTTGCAGTTGGGCAGTTCTGGTTTTCTGCAATCTTCTAAT  24180
        P  N  S  R  R  S  D  L  Q  L  G  S  S  G  F  L  Q  S  S  N
         P  T  P  D  D  L  I  C  S  W  A  V  L  V  F  C  N  L  L  I
          Q  L  Q  T  I  *  F  A  V  G  Q  F  W  F  S  A  I  F  *  L

24181  TATAAAATTGACACTACTTCTAGTTCTTGTCAATTGTATTATAGTTTGCCTGCAATTAAT  24240
        Y  K  I  D  T  T  S  S  S  C  Q  L  Y  Y  S  L  P  A  I  N
         I  K  L  T  L  L  V  L  V  N  C  I  I  V  C  L  Q  L  M
          *  N  *  H  Y  F  *  F  L  S  I  V  L  *  F  A  C  N  *  C

24241  GTTACTATTAATAATTATAATCCTTCTTCTTGGAATAGAAGGTATGGTTTTAATAATTTT  24300
        V  T  I  N  N  Y  N  P  S  S  W  N  R  R  Y  G  F  N  N  F
         L  L  L  I  I  I  I  L  L  L  G  I  E  G  M  V  L  I  I  L
          Y  Y  *  *  L  *  S  F  F  L  E  *  K  V  W  F  *  *  F  *
```

FIG. 2 CONT'D

```
24301  AATTTGAGCTCTCATAGTGTTGTTTACTCACGTTATTGTTTTTCTGTTAATAATACTTTT  24360
         N  L  S  S  H  S  V  V  Y  S  R  Y  C  F  S  V  N  N  T  F
          I  *  A  L  I  V  L  F  T  H  V  I  V  F  L  L  I  I  L  F
           F  E  L  S  *  C  C  L  L  T  L  L  F  F  C  *  *  Y  F  L

24361  TGTCCTTGTGCTAAACCTTCTTTTGCTTCAAGTTGCAAGAGTCATAAACCACCTTCTGCT  24420
         C  P  C  A  K  P  S  F  A  S  S  C  K  S  H  K  P  P  S  A
          V  L  V  L  N  L  L  L  Q  V  A  R  V  I  N  H  L  L
           S  L  C  *  T  F  F  C  F  K  L  Q  E  S  *  T  T  F  C  F

24421  TCCTGTCCTATTGGTACTAATTATCGTTCTTGTGAGAGTACTACTGTACTCGACCACACT  24480
         S  C  P  I  G  T  N  Y  R  S  C  E  S  T  T  V  L  D  H  T
          P  V  L  L  V  L  I  I  V  L  V  R  V  L  L  Y  S  T  T  L
           L  S  Y  W  Y  *  L  S  F  L  *  E  Y  Y  C  T  R  P  H  *

24481  GACTGGTGTAGGTGTTCTTGTTTACCTGATCCTATAACTGCTTATGACCCTAGGTCTTGT  24540
         D  W  C  R  C  S  C  L  P  D  P  I  T  A  Y  D  P  R  S  C
          T  G  V  G  V  L  V  Y  L  I  L  *  L  L  M  T  L  G  L  V
           L  V  *  V  F  L  F  T  *  S  Y  N  C  L  *  P  *  V  L  F

24541  TCTCAAAAAAAGTCTCTGGTTGGTGTTGGTGAACATTGTGCAGGGTTCGGTGTTGATGAA  24600
         S  Q  K  K  S  L  V  G  V  G  E  H  C  A  G  F  G  V  D  E
          L  K  K  S  L  W  L  V  L  V  N  I  V  Q  G  S  V  L  M  K
           S  K  K  V  S  G  W  C  W  *  T  L  C  R  V  R  C  *  *  R

24601  GAAAAGTGTGGTGTATTGGATGGATCATATAATGTTTCTTGTCTTTGTAGTACTGATGCC  24660
         E  K  C  G  V  L  D  G  S  Y  N  V  S  C  L  C  S  T  D  A
          K  S  V  V  Y  W  M  D  H  I  M  F  L  V  F  V  V  L  M  P
           K  V  W  C  I  G  W  I  I  *  C  F  L  S  L  *  Y  *  C  L

24661  TTTCTAGGTTGGTCTTATGACACTTGCGTCAGTAACAACCGTTGTAATATTTTTTCTAAT  24720
         F  L  G  W  S  Y  D  T  C  V  S  N  N  R  C  N  I  F  S  N
          F  *  V  G  L  M  T  L  A  S  V  T  T  V  V  I  F  F  L  I
           S  R  L  V  L  *  H  L  R  Q  *  Q  P  L  *  Y  F  F  *  F

24721  TTTATTTTAAATGGTATCAATAGTGGTACCACTTGTTCTAATGATTTATTGCAGCCTAAT  24780
         F  I  L  N  G  I  N  S  G  T  T  C  S  N  D  L  L  Q  P  N
          L  F  *  M  V  S  I  V  V  P  L  V  L  M  I  Y  C  S  L  I
           Y  F  K  W  Y  Q  *  W  Y  H  L  F  *  *  F  I  A  A  *  Y

24781  ACTGAAGTTTTTACTGATGTTTGTGTTGATTACGACCTTTATGGTATTACAGGACAAGGT  24840
         T  E  V  F  T  D  V  C  V  D  Y  D  L  Y  G  I  T  G  Q  G
          L  K  F  L  L  M  F  V  L  I  T  T  F  M  V  L  Q  D  K  V
           *  S  F  Y  *  C  L  C  *  L  R  P  L  W  Y  Y  R  T  R  Y
```

FIG. 2 CONT'D

```
24841   ATTTTTAAAGAAGTTTCTGCTGTTTATTATAATAGTTGGCAAAATCTTTTGTATGATTCT   24900
         I  F  K  E  V  S  A  V  Y  Y  N  S  W  Q  N  L  L  Y  D  S
          F  L  K  K  F  L  L  F  I  I  I  V  G  K  I  F  C  M  I  L
           F  *  R  S  F  C  C  L  L  *  *  L  A  K  S  F  V  *  F  *

24901   AATGGCAACATTATTGGTTTTAAAGATTTTGTTACTAATAAAACATATAATATTTTCCCT   24960
         N  G  N  I  I  G  F  K  D  F  V  T  N  K  T  Y  N  I  F  P
          M  A  T  L  L  V  L  K  I  L  L  L  I  K  H  I  I  F  S  L
           W  Q  H  Y  W  F  *  R  F  C  Y  *  *  N  I  *  Y  F  P  L

24961   TGTTATGCAGGAAGAGTTTCTGCTGCTTTTCATCAAAATGCTTCCTCTTTGGCTTTACTT   25020
         C  Y  A  G  R  V  S  A  A  F  H  Q  N  A  S  S  L  A  L  L
          V  M  Q  E  E  F  L  L  L  F  I  K  M  L  P  L  W  L  Y  F
           L  C  R  K  S  F  C  C  F  S  S  K  C  F  L  F  G  F  T  L

25021   TATCGTAATTTAAAATGTAGCTATGTTTTGAATAATATTTCTTTAACTACTCAGCCATAT   25080
         Y  R  N  L  K  C  S  Y  V  L  N  N  I  S  L  T  T  Q  P  Y
          I  V  I  *  N  V  A  M  F  *  I  I  F  L  *  L  L  S  H  I
           S  *  F  K  M  *  L  C  F  E  *  Y  F  F  N  Y  S  A  I  F

25081   TTTGATAGTTATCTTGGTTGCGTTTTTAATGCTGATAATTTAACTGATTATTCTGTTTCT   25140
         F  D  S  Y  L  G  C  V  F  N  A  D  N  L  T  D  Y  S  V  S
          L  I  V  I  L  V  A  F  L  M  L  I  I  *  L  I  I  L  F  L
           *  *  L  S  W  L  R  F  *  C  *  *  F  N  *  L  F  C  F  F

25141   TCTTGTGCTCTTCGCATGGGTAGTGGTTTTTGTGTTGATTATAACTCACCTTCTTCTTCC   25200
         S  C  A  L  R  M  G  S  G  F  C  V  D  Y  N  S  P  S  S  S
          L  V  L  F  A  W  V  V  V  F  V  L  I  I  T  H  L  L  L  P
           L  C  S  S  H  G  *  W  F  L  C  *  L  *  L  T  F  F  F  L

25201   TCTTCGCGTCGTAAACGTAGAAGTATTTCTGCTTCTTATCGTTTTGTTACTTTTGAACCC   25260
         S  S  R  R  K  R  R  S  I  S  A  S  Y  R  F  V  T  F  E  P
          L  R  V  V  N  V  E  V  F  L  L  L  I  V  L  L  L  N  P
           F  A  S  *  T  *  K  Y  F  C  F  L  S  F  C  Y  F  *  T  L

25261   TTTAATGTCAGTTTTGTTAATGACAGTATTGAGTCTGTGGGTGGTCTTTATGAGATCAAA   25320
         F  N  V  S  F  V  N  D  S  I  E  S  V  G  G  L  Y  E  I  K
          L  M  S  V  L  L  M  T  V  L  S  L  W  V  V  F  M  R  S  K
           *  C  Q  F  C  *  *  Q  Y  *  V  C  G  W  S  L  *  D  Q  N

25321   ATTCCCACTAACTTTACTATAGTTGGTCAAGAGGAATTTATTCAAACTAATTCTCCTAAA   25380
         I  P  T  N  F  T  I  V  G  Q  E  E  F  I  Q  T  N  S  P  K
          F  P  L  T  L  L  *  L  V  K  R  N  L  F  K  L  I  L  L  K
           S  H  *  L  Y  Y  S  W  S  R  G  I  Y  S  N  *  F  S  *  S
```

FIG. 2 CONT'D

```
25381  GTTACTATTGATTGTTCTTTATTTGTCTGTTCTAATTATGCAGCTTGCCATGACTTATTG  25440
        V  T  I  D  C  S  L  F  V  C  S  N  Y  A  A  C  H  D  L  L
         L  L  L  I  V  L  Y  L  S  V  L  I  M  Q  L  A  M  T  Y  C
          Y  Y  *  L  F  F  I  C  L  F  *  L  C  S  L  P  *  L  I  V

25441  TCAGAGTATGGCACTTTTTGTGATAATATTAATAGTATTTTAGATGAAGTTAATGGTTTA  25500
        S  E  Y  G  T  F  C  D  N  I  N  S  I  L  D  E  V  N  G  L
         Q  S  M  A  L  F  V  I  I  L  I  V  F  *  M  K  L  M  V  Y
          R  V  W  H  F  L  *  *  Y  *  *  Y  F  R  *  S  *  W  F  T

25501  CTTGATACTACTCAATTGCATGTAGCTGATACTCTTATGCAAGGTGTCACACTTAGCTCC  25560
        L  D  T  T  Q  L  H  V  A  D  T  L  M  Q  G  V  T  L  S  S
         L  I  L  L  N  C  M  *  L  I  L  L  C  K  V  S  H  L  A  P
          *  Y  Y  S  I  A  C  S  *  Y  S  Y  A  R  C  H  T  *  L  Q

25561  AATCTTAATACTAATTTGCATTTTGATGTTGATAATATTAATTTTAAATCCCTAGTTGGA  25620
        N  L  N  T  N  L  H  F  D  V  D  N  I  N  F  K  S  L  V  G
         I  L  I  L  I  C  I  L  M  L  I  I  L  I  L  N  P  *  L  D
          S  *  Y  *  F  A  F  *  C  *  *  Y  *  F  *  I  P  S  W  M

25621  TGTTTAGGTCCACACTGCGGTTCTTCTTCTCGTTCTTTTTTTGAAGATTTATTGTTTGAC  25680
        C  L  G  P  H  C  G  S  S  S  R  S  F  F  E  D  L  L  F  D
         V  *  V  H  T  A  V  L  L  L  V  L  F  L  K  I  Y  C  L  T
          F  R  S  T  L  R  F  F  F  S  F  F  F  *  R  F  I  V  *  Q

25681  AAAGTTAAACTTTCAGATGTTGGTTTTGTTGAAGCTTATAACAATTGTACTGGTGGTAGT  25740
        K  V  K  L  S  D  V  G  F  V  E  A  Y  N  N  C  T  G  G  S
         K  L  N  F  Q  M  L  V  L  L  K  L  I  T  I  V  L  V  V  V
          S  *  T  F  R  C  W  F  C  *  S  L  *  Q  L  Y  W  W  *  *

25741  GAAATTAGAGATCTTCTTTGTGTACAATCCTTTAATGGTATTAAAGTTTTGCCTCCTATT  25800
        E  I  R  D  L  L  C  V  Q  S  F  N  G  I  K  V  L  P  P  I
         K  L  E  I  F  F  V  Y  N  P  L  M  V  L  K  F  C  L  L  F
          N  *  R  S  S  L  C  T  I  L  *  W  Y  *  S  F  A  S  Y  F

25801  TTGTCTGAATCTCAAATTTCTGGTTACACCACAGCCGCTACTGTTGCTGCTATGTTTCCA  25860
        L  S  E  S  Q  I  S  G  Y  T  T  A  A  T  V  A  A  M  F  P
         C  L  N  L  K  F  L  V  T  P  Q  P  L  L  L  L  C  F  H
          V  *  I  S  N  F  W  L  H  H  S  R  Y  C  C  C  Y  V  S  T

25861  CCATGGTCAGCAGCAGCTGGCATACCATTTTCTCTTAATGTACAATATAGAATTAATGGT  25920
        P  W  S  A  A  A  G  I  P  F  S  L  N  V  Q  Y  R  I  N  G
         H  G  Q  Q  Q  L  A  Y  H  F  L  L  M  Y  N  I  E  L  M  V
          M  V  S  S  S  W  H  T  I  F  S  *  C  T  I  *  N  *  W  F
```

```
25921   TTGGGTGTTACTATGGATGTTCTTAATAAAAATCAAAAGTTGATAGCTACTGCTTTTAAT   25980
        L  G  V  T  M  D  V  L  N  K  N  Q  K  L  I  A  T  A  F  N
         W  V  L  L  W  M  F  L  I  K  I  K  S  *  *  L  L  L  L  I
          G  C  Y  Y  G  C  S  *  *  K  S  K  V  D  S  Y  C  F  *  *

25981   AATGCTCTTCTTTCTATTCAGAATGGTTTTAGTGCTACCAACTCTGCACTTGCTAAAATA   26040
        N  A  L  L  S  I  Q  N  G  F  S  A  T  N  S  A  L  A  K  I
         M  L  F  F  L  F  R  M  V  L  V  L  P  T  L  H  L  L  K  Y
          C  S  S  F  Y  S  E  W  F  *  C  Y  Q  L  C  T  C  *  N  T

26041   CAAAGTGTTGTTAATTCTAATGCTCAAGCACTTAATAGTTTGTTACAGCAATTATTTAAT   26100
        Q  S  V  V  N  S  N  A  Q  A  L  N  S  L  L  Q  Q  L  F  N
         K  V  L  L  I  L  M  L  K  H  L  I  V  C  Y  S  N  Y  L  I
          K  C  C  *  F  *  C  S  S  T  *  *  F  V  T  A  I  I  *  *

26101   AAATTTGGTGCAATTAGTTCTTCTTTACAAGAAATTTTATCTCGTCTCGATGCTTTAGAG   26160
        K  F  G  A  I  S  S  S  L  Q  E  I  L  S  R  L  D  A  L  E
         N  L  V  Q  L  V  L  L  Y  K  K  F  Y  L  V  S  M  L  *  R
          I  W  C  N  *  F  F  F  T  R  N  F  I  S  S  R  C  F  R  G

26161   GCTCAGGTTCAGATTGATAGGCTTATTAATGGTCGTTTAACTGCTTTAAATGCTTATGTC   26220
        A  Q  V  Q  I  D  R  L  I  N  G  R  L  T  A  L  N  A  Y  V
         L  R  F  R  L  I  G  L  L  M  V  V  *  L  L  *  M  L  M  S
          S  G  S  D  *  *  A  Y  *  W  S  F  N  C  F  K  C  L  C  L

26221   TCTCAACAGCTTAGTGATATTTCTCTTGTAAAATTTGGTGCTGCTTTAGCTATGGAGAAG   26280
        S  Q  Q  L  S  D  I  S  L  V  K  F  G  A  A  L  A  M  E  K
         L  N  S  L  V  I  F  L  L  *  N  L  V  L  L  *  L  W  R  R
          S  T  A  *  *  Y  F  S  C  K  I  W  C  C  F  S  Y  G  E  G

26281   GTTAATGAGTGTGTTAAAAGTCAATCTCCTCGTATTAATTTTTGTGGTAATGGTAATCAT   26340
        V  N  E  C  V  K  S  Q  S  P  R  I  N  F  C  G  N  G  N  H
         L  M  S  V  L  K  V  N  L  L  V  L  I  F  V  V  M  V  I  I
          *  *  V  C  *  K  S  I  S  S  Y  *  F  L  W  *  W  *  S  Y

26341   ATTTTGTCATTAGTTCAAAATGCTCCTTATGGTTTGTTGTTTATGCATTTTAGTTATAAA   26400
        I  L  S  L  V  Q  N  A  P  Y  G  L  L  F  M  H  F  S  Y  K
         F  C  H  *  F  K  M  L  L  M  V  C  C  L  C  I  L  V  I  N
          F  V  I  S  S  K  C  S  L  W  F  V  V  Y  A  F  *  L  *  T

26401   CCTATTTCTTTTAAAACTGTTTTAGTAAGTCCTGGTTTGTGTATATCAGGTGATGTAGGT   26460
        P  I  S  F  K  T  V  L  V  S  P  G  L  C  I  S  G  D  V  G
         L  F  L  L  K  L  F  *  *  V  L  V  C  V  Y  Q  V  M  *  V
          Y  F  F  *  N  C  F  S  K  S  W  F  V  Y  I  R  *  C  R  Y
```

FIG. 2 CONT'D

```
26461  ATTGCACCTAAACAAGGGTATTTTATTAAACATAATGATCATTGGATGTTCACTGGTAGT  26520
       I  A  P  K  Q  G  Y  F  I  K  H  N  D  H  W  M  F  T  G  S
        L  H  L  N  K  G  I  L  L  N  I  M  I  I  G  C  S  L  V  V
         C  T  *  T  R  V  F  Y  *  T  *  *  S  L  D  V  H  W  *  F

26521  TCTTACTATTATCCTGAACCAATTTCAGATAAAAATGTTGTTTTTATGAATACTTGTTCT  26580
       S  Y  Y  Y  P  E  P  I  S  D  K  N  V  V  F  M  N  T  C  S
        L  T  I  I  L  N  Q  F  Q  I  K  M  L  F  L  *  I  L  V  L
         L  L  L  S  *  T  N  F  R  *  K  C  C  F  Y  E  Y  L  F  C

26581  GTTAATTTTACTAAAGCGCCTCTTGTTTATTTGAATCATTCTGTACCAAAATTGTCTGAT  26640
       V  N  F  T  K  A  P  L  V  Y  L  N  H  S  V  P  K  L  S  D
        L  I  L  L  K  R  L  L  F  I  *  I  I  L  Y  Q  N  C  L  I
         *  F  Y  *  S  A  S  C  L  F  E  S  F  C  T  K  I  V  *  F

26641  TTTGAATCTGAGTTATCTCATTGGTTTAAAAATCAAACATCCATTGCGCCTAATTTGACT  26700
       F  E  S  E  L  S  H  W  F  K  N  Q  T  S  I  A  P  N  L  T
        L  N  L  S  Y  L  I  G  L  K  I  K  H  P  L  R  L  I  *  L
         *  I  *  V  I  S  L  V  *  K  S  N  I  H  C  A  *  F  D  F

26701  TTAAATCTTCATACTATTAATGCTACTTTTTTAGATTTGTATTATGAGATGAATCTTATT  26760
       L  N  L  H  T  I  N  A  T  F  L  D  L  Y  Y  E  M  N  L  I
        *  I  F  I  L  L  M  L  L  F  *  I  C  I  M  R  *  I  L  F
         K  S  S  Y  Y  *  C  Y  F  F  R  F  V  L  *  D  E  S  Y  S

26761  CAAGAGTCTATTAAGTCTTTGAATAATAGTTATATCAATCTTAAAGATATAGGTACATAT  26820
       Q  E  S  I  K  S  L  N  N  S  Y  I  N  L  K  D  I  G  T  Y
        K  S  L  L  S  L  *  I  I  V  I  S  I  L  K  I  *  V  H  M
         R  V  Y  *  V  F  E  *  *  L  Y  Q  S  *  R  Y  R  Y  I  *

26821  GAAATGTATGTAAAATGGCCTTGGTATGTTTGGCTACTAATTTCTTTTTCATTTATAATA  26880
       E  M  Y  V  K  W  P  W  Y  V  W  L  L  I  S  F  S  F  I  I
        K  C  M  *  N  G  L  G  M  F  G  Y  *  F  L  F  H  L  *  Y
         N  V  C  K  M  A  L  V  C  L  A  T  N  F  F  F  I  Y  N  I

26881  TTCCTTGTATTGCTCTTTTTTATATGTTGTTGTACTGGTTGTGGTTCTGCATGTTTTAGT  26940
       F  L  V  L  L  F  F  I  C  C  C  T  G  C  G  S  A  C  F  S
        S  L  Y  C  S  F  L  Y  V  V  V  L  V  V  V  L  H  V  L  V
         P  C  I  A  L  F  Y  M  L  L  Y  W  L  W  F  C  M  F  *  *

26941  AAATGTCATAATTGTTGTGATGAGTATGGTGGTCATCATGATTTTGTTATCAAAACATCT  27000
       K  C  H  N  C  C  D  E  Y  G  G  H  H  D  F  V  I  K  T  S
        N  V  I  I  V  V  M  S  M  V  V  I  M  I  L  L  S  K  H  L
         M  S  *  L  L  *  *  V  W  W  S  S  *  F  C  Y  Q  N  I  S
```

FIG. 2 CONT'D

| | | |
|---|---|---|
| 27001 | CATGATGATTAGAATCTCTTGTCAGATCTCATTAAATCTAAACTTTATTTATGGACGTTT | 27060 |
| | H D D * N L L S D L I K S K L Y L W T F | |
| | M M I R S C Q I S L N L N F I Y G R L | |
| | * * L E S L V R S H * I * T L F M D V W | |

| | | |
|---|---|---|
| 27061 | GGAGACCTAGCTACACACATTCTCTTGTTATTAGAGAATTTGGTGTTACAAACCTTGAAG | 27120 |
| | G D L A T H I L L L E N L V L Q T L K | |
| | E T * L H T F S C Y * R I W C Y K P * R | |
| | R P S Y T H S L V I R E F G V T N L E D | |

| | | |
|---|---|---|
| 27121 | ATTTGTGTCTAAAGTATAATTACTGTCAACCTATTGTTGGTTACTGTATTGTACCTTTAA | 27180 |
| | I C V * S I I T V N L L L V T V L Y L * | |
| | F V S K V * L L S T Y C W L L Y C T F K | |
| | L C L K Y N Y C Q P I V G Y C I V P L N | |

| | | |
|---|---|---|
| 27181 | ATGTTTGGTGTCGCAAGTTTGGCAAATTTGCTTCTCACTTTACATTACGTAGTCACGATA | 27240 |
| | M F G V A S L A N L L L T L H Y V V T I | |
| | C L V S Q V W Q I C F S L Y I T * S R Y | |
| | V W C R K F G K F A S H F T L R S H D I | |

| | | |
|---|---|---|
| 27241 | TTTCCCATAGTAATAATTTTGGTGTTGTAACTAGTTTTACTACTTATGGTAATACTGTTT | 27300 |
| | F P I V I I L V L * L V L L L M V I L F | |
| | F P * * * F W C C N * F Y Y L W * Y C F | |
| | S H S N N F G V V T S F T T Y G N T V S | |

| | | |
|---|---|---|
| 27301 | CTGAGGCTGTGTCTAGATTAGTTGAATCAGCTTCTGAATTTATTGTTTGGCGTGCAGAGG | 27360 |
| | L R L C L D * L N Q L L N L L F G V Q R | |
| | * G C V * I S * I S F * I Y C L A C R G | |
| | E A V S R L V E S A S E F I V W R A E A | |

| | | |
|---|---|---|
| 27361 | CACTTAATAAGTATGGTTGATTTATTTTTCAATGATACTGCTTGGTACATAGGACAGATT | 27420 |
| | H L I S M V D L F F N D T A W Y I G Q I | |
| | T * * V W L I Y F S M I L L G T * D R F | |
| | L N K Y G * F I F Q * Y C L V H R T D F | |

| | | |
|---|---|---|
| 27421 | TTAGTTTTAGTTTTATTTTGTCTTATTTCTTTAATCTTTGTTGTTGCTTTTTTAGCAACT | 27480 |
| | L V L V L F C L I S L I F V V A F L A T | |
| | * F * F Y F V L F L * S L L L L F * Q L | |
| | S F S F I L S Y F F N L C C C F F S N Y | |

| | | |
|---|---|---|
| 27481 | ATTAAGCTTTGTATGCAACTTTGTGGTTTTTGTAATTTCTTTATTATTTCACCTTCGGCT | 27540 |
| | I K L C M Q L C G F C N F F I I S P S A | |
| | L S F V C N F V V F V I S L L F H L R L | |
| | * A L Y A T L W F L * F L Y Y F T F G L | |

FIG. 2 CONT'D

```
27541   TACGTTTATAAAAGAGGTATGCAGTTGTATAAGTCTTATAGTGAACAAGTTATACCACCC   27600
         Y  V  Y  K  R  G  M  Q  L  Y  K  S  Y  S  E  Q  V  I  P  P
          T  F  I  K  E  V  C  S  C  I  S  L  I  V  N  K  L  Y  H  P
           R  L  *  K  R  Y  A  V  V  *  V  L  *  *  T  S  Y  T  T  H

27601   ACTTCAGATTATTTAATCTAAATCTAAACATTATGAATAAATCTTTTCTTCCTCAATTTA   27660
         T  S  D  Y  L  I  *  I  *  T  L  *  I  N  L  F  F  L  N  L
          L  Q  I  I  *  S  K  S  K  H  Y  E  *  I  F  S  S  S  I  Y
           F  R  L  F  N  L  N  L  N  I  M  N  K  S  F  L  P  Q  F  T

27661   CTTCTGATCAAGCTGTTACATTCTTAAAAGAATGGAATTTCTCTTTGGGTGTAATACTAC   27720
         L  L  I  K  L  L  H  S  *  K  N  G  I  S  L  W  V  *  Y  Y
          F  *  S  S  C  Y  I  L  K  R  M  E  F  L  F  G  C  N  T  T
           S  D  Q  A  V  T  F  L  K  E  W  N  F  S  L  G  V  I  L  L

27721   TTTTTATTACTATCATATTGCAGTTCGGTTATACGAGCCGTAGTATGTTTGTTTATCTTA   27780
         F  L  L  L  S  Y  C  S  S  V  I  R  A  V  V  C  L  F  I  L
          F  Y  Y  Y  H  I  A  V  R  L  Y  E  P  *  Y  V  C  L  S  Y
           F  I  T  I  I  L  Q  F  G  Y  T  S  R  S  M  F  V  Y  L  I

27781   TCAAGATGATTATTCTTTGGCTTATGTGGCCATTGACTATCACCTTGACTATATTTAATT   27840
         S  R  *  L  F  F  G  L  C  G  H  *  L  S  P  *  L  Y  L  I
          Q  D  D  Y  S  L  A  Y  V  A  I  D  Y  H  L  D  Y  I  *  L
           K  M  I  I  L  W  L  M  W  P  L  T  I  T  L  T  I  F  N  C

27841   GTTTTTATGCTTTGAATAATGCTTTTCTTGCATTTTCTATAGTGTTTACTATTATTTCTA   27900
         V  F  M  L  *  I  M  L  F  L  H  F  L  *  C  L  L  L  F  L
          F  L  C  F  E  *  C  F  S  C  I  F  Y  S  V  Y  Y  Y  F  Y
           F  Y  A  L  N  N  A  F  L  A  F  S  I  V  F  T  I  I  S  I

27901   TTGTTATATGGATTCTTTATTTTGTTAATAGTATTCGGCTTTTTATTAGAACTGGCAGTT   27960
         L  L  Y  G  F  F  I  L  L  I  V  F  G  F  L  L  E  L  A  V
          C  Y  M  D  S  L  F  C  *  *  Y  S  A  F  Y  *  N  W  Q  L
           V  I  W  I  L  Y  F  V  N  S  I  R  L  F  I  R  T  G  S  W

27961   GGTGGAGTTTTAATCCAGAGACCAATAATCTTATGTGTATTGATATGAAAGGCAAGATGT   28020
         G  G  V  L  I  Q  R  P  I  I  L  C  V  L  I  *  K  A  R  C
          V  E  F  *  S  R  D  Q  *  S  Y  V  V  *  Y  E  R  Q  D  V
           W  S  F  N  P  E  T  N  N  L  M  C  I  D  M  K  G  K  M  F

28021   TTGTTAGGCCAGTTATTGAGGACTATCACACATTAACTGCTACTGTTATTCGTGGTCATC   28080
         L  L  G  Q  L  L  R  T  I  T  H  *  L  L  L  L  F  V  V  I
          C  *  A  S  Y  *  G  L  S  H  I  N  C  Y  C  Y  S  W  S  S
           V  R  P  V  I  E  D  Y  H  T  L  T  A  T  V  I  R  G  H  L
```

FIG. 2 CONT'D

| | | |
|---|---|---|
| 28081 | TTTATATACAGGGTGTCAAACTTGGCACTGGTTATACTCTTTCAGATTTGCCCGTATATG | 28140 |
| | F I Y R V S N L A L V I L F Q I C P Y M | |
| | L Y T G C Q T W H W L Y S F R F A R I C | |
| | Y I Q G V K L G T G Y T L S D L P V Y V | |
| 28141 | TTACTGTAGCTAAGGTGCAAGTACTTTGTACCTATAAACGTGCCTTTTTAGATAAGTTAG | 28200 |
| | L L * L R C K Y F V P I N V P F * I S * | |
| | Y C S * G A S T L Y L * T C L F R * V R | |
| | T V A K V Q V L C T Y K R A F L D K L D | |
| 28201 | ATGTTAATAGTGGTTTTGCTGTTTTTGTTAAGTCTAAAGTTGGTAACTATCGTTTACCGT | 28260 |
| | M L I V V L L F L L S L K L V T I V Y R | |
| | C * * W F C C F C * V * S W * L S F T V | |
| | V N S G F A V F V K S K V G N Y R L P S | |
| 28261 | CTAGTAAACCTAGTGGTATGGATACTGCCTTGTTAAGAGCTTAAATCTAAACTATTAGGA | 28320 |
| | L V N L V V W I L P C * E L K S K L L G | |
| | * * T * W Y G Y C L V K S L N L N Y * D | |
| | S K P S G M D T A L L R A * I * T I R M | |
| 28321 | TGTCTTATACTCCCGGTCATTATGCTGGAAGTAGAAGCTCCTCTGGAAATCGTTCAGGAA | 28380 |
| | C L I L P V I M L E V E A P L E I V Q E | |
| | V L Y S R S L C W K * K L L W K S F R N | |
| | S Y T P G H Y A G S R S S S G N R S G I | |
| 28381 | TCCTCAAGAAAACTTCTTGGGCTGACCAATCTGAGCGAAATTACCAAACCTTTAATAGAG | 28440 |
| | S S R K L L G L T N L S E I T K P L I E | |
| | P Q E N F L G * P I * A K L P N L * * R | |
| | L K K T S W A D Q S E R N Y Q T F N R G | |
| 28441 | GCAGAAAAACCCAACCTAAATTCACTGTGTCTACTCAACCACAAGGAAATACTATCCCAC | 28500 |
| | A E K P N L N S L C L L N H K E I L S H | |
| | Q K N P T * I H C V Y S T T R K Y Y P T | |
| | R K T Q P K F T V S T Q P Q G N T I P H | |
| 28501 | ATTATTCCTGGTTCTCCGGGATCACTCAATTTCAAAAAGGTAGAGACTTTAAATTTTCAG | 28560 |
| | I I P G S P G S L N F K K V E T L N F Q | |
| | L F L V L R D H S I S K R * R L * I F R | |
| | Y S W F S G I T Q F Q K G R D F K F S D | |
| 28561 | ATGGTCAAGGAGTTCCCATTGCTTTCGGAGTACCCCCTTCTGAAGCAAAAGGATATTGGT | 28620 |
| | M V K E F P L L S E Y P L L K Q K D I G | |
| | W S R S S H C F R S T P F * S K R I L V | |
| | G Q G V P I A F G V P P S E A K G Y W Y | |

FIG. 2 CONT'D

```
28621   ATAGACACAGCCGGCGTTCTTTTAAAACAGCTGATGGTCAACAAAAGCAGTTGTTACCGA   28680
          I  D  T  A  G  V  L  L  K  Q  L  M  V  N  K  S  S  C  Y  R
         *  T  Q  P  A  F  F  *  N  S  *  W  S  T  K  A  V  V  T  E
           R  H  S  R  R  S  F  K  T  A  D  G  Q  Q  K  Q  L  L  P  R

28681   GATGGTATTTCTACTATCTCGGTACCGGCCCATATGCCAATGCATCCTATGGTGAATCCC   28740
          D  G  I  S  T  I  S  V  P  A  H  M  P  M  H  P  M  V  N  P
         M  V  F  L  L  S  R  Y  R  P  I  C  Q  C  I  L  W  *  I  P
           W  Y  F  Y  Y  L  G  T  G  P  Y  A  N  A  S  Y  G  E  S  L

28741   TCGAAGGGGTCTTCTGGGTTGCTAATCACCAAGCTGACACTTCTACTCCCTCCGATGTTT   28800
          S  K  G  S  S  G  L  L  I  T  K  L  T  L  L  P  P  M  F
         R  R  G  L  L  G  C  *  S  P  S  *  H  F  Y  S  L  R  C  F
           E  G  V  F  W  V  A  N  H  Q  A  D  T  S  T  P  S  D  V  S

28801   CGTCAAGGGATCCTACTACTCAAGAAGCTATCCCTACTAGGTTTCCGCCTGGTACGATTT   28860
          R  Q  G  I  L  L  L  K  K  L  S  L  L  G  F  R  L  V  R  F
         V  K  G  S  Y  Y  S  R  S  Y  P  Y  *  V  S  A  W  Y  D  F
           S  R  D  P  T  T  Q  E  A  I  P  T  R  F  P  P  G  T  I  L

28861   TGCCTCAAGGCTATTATGTTGAAGGCTCAGGAAGGTCTGCTTCTAATAGTCGACCAGGTT   28920
          C  L  K  A  I  M  L  K  A  Q  E  G  L  L  L  I  V  D  Q  V
         A  S  R  L  L  C  *  R  L  R  K  V  C  F  *  *  S  T  R  F
           P  Q  G  Y  Y  V  E  G  S  G  R  S  A  S  N  S  R  P  G  S

28921   CACGTTCTCAATCACGTGGACCCAATAATCGTTCATTAAGTAGAAGTAATTCTAATTTTA   28980
          H  V  L  N  H  V  D  P  I  I  V  H  *  V  E  V  I  L  I  L
         T  F  S  I  T  W  T  Q  *  S  F  I  K  *  K  *  F  *  F  *
           R  S  Q  S  R  G  P  N  N  R  S  L  S  R  S  N  S  N  F  R

28981   GACATTCAGATTCTATAGTAAAACCTGATATGGCTGATGAGATCGCTAATCTTGTTTTAG   29040
          D  I  Q  I  L  *  *  N  L  I  W  L  M  R  S  L  I  L  F  *
         T  F  R  F  Y  S  K  T  *  Y  G  *  *  D  R  *  S  C  F  S
           H  S  D  S  I  V  K  P  D  M  A  D  E  I  A  N  L  V  L  A

29041   CCAAGCTTGGTAAAGATTCTAAACCTCAGCAAGTCACTAAGCAAAATGCCAAGGAAATCA   29100
          P  S  L  V  K  I  L  N  L  S  K  S  L  S  K  M  P  R  K  S
         Q  A  W  *  R  F  *  T  S  A  S  H  *  A  K  C  Q  G  N  Q
           K  L  G  K  D  S  K  P  Q  Q  V  T  K  Q  N  A  K  E  I  R

29101   GGCATAAAATTTTAACAAAACCTCGCCAAAAGCGAACTCCTAATAAACATTGTAATGTTC   29160
          G  I  K  F  *  Q  N  L  A  K  S  E  L  L  I  N  I  V  M  F
         A  *  N  F  N  K  T  S  P  K  A  N  S  *  *  T  L  *  C  S
           H  K  I  L  T  K  P  R  Q  K  R  T  P  N  K  H  C  N  V  Q
```

FIG. 2 CONT'D

| | | |
|---|---|---|
| 29161 | AACAGTGTTTTGGTAAAAGAGGACCTTCTCAAAATTTTGGTAATGCTGAAATGTTAAAGC | 29220 |
| | N  S  V  L  V  K  E  D  L  L  K  I  L  V  M  L  K  C  *  S | |
| | T  V  F  W  *  K  R  T  F  S  K  F  W  *  C  *  N  V  K  A | |
| | Q  C  F  G  K  R  G  P  S  Q  N  F  G  N  A  E  M  L  K  L | |
| 29221 | TTGGTACTAATGATCCTCAGTTTCCTATTCTTGCAGAATTAGCTCCTACACCAGGTGCTT | 29280 |
| | L  V  L  M  I  L  S  F  L  F  L  Q  N  *  L  L  H  Q  V  L | |
| | W  Y  *  *  S  S  V  S  Y  S  C  R  I  S  S  Y  T  R  C  F | |
| | G  T  N  D  P  Q  F  P  I  L  A  E  L  A  P  T  P  G  A  F | |
| 29281 | TTTTCTTTGGTTCTAAATTAGACTTGGTTAAAAGAGATTCCGAGGCTGACTCACCTGTTA | 29340 |
| | F  S  L  V  L  N  *  T  W  L  K  E  I  P  R  L  T  H  L  L | |
| | F  L  W  F  *  I  R  L  G  *  K  R  F  R  G  *  L  T  C  * | |
| | F  F  G  S  K  L  D  L  V  K  R  D  S  E  A  D  S  P  V  K | |
| 29341 | AAGATGTTTTTGAACTTCATTATTCTGGTTCTATTAGGTTTGATAGTACTTTACCAGGCT | 29400 |
| | K  M  F  L  N  F  I  I  L  V  L  L  G  L  I  V  L  Y  Q  A | |
| | R  C  F  *  T  S  L  F  W  F  Y  *  V  *  *  Y  F  T  R  L | |
| | D  V  F  E  L  H  Y  S  G  S  I  R  F  D  S  T  L  P  G  F | |
| 29401 | TTGAGACAATTATGAAAGTTCTTGAAGAGAATTTAAATGCTTACGTTAATTCTAATCAGA | 29460 |
| | L  R  Q  L  *  K  F  L  K  R  I  *  M  L  T  L  I  L  I  R | |
| | *  D  N  Y  E  S  S  *  R  E  F  K  C  L  R  *  F  *  S  E | |
| | E  T  I  M  K  V  L  E  E  N  L  N  A  Y  V  N  S  N  Q  N | |
| 29461 | ACACTGATTCTGATTCGTTGAGTTCTAAACCTCAGCGTAAAAGAGGTGTTAAACAATTAC | 29520 |
| | T  L  I  L  I  R  *  V  L  N  L  S  V  K  E  V  L  N  N  Y | |
| | H  *  F  *  F  V  E  F  *  T  S  A  *  K  R  C  *  T  I  T | |
| | T  D  S  D  S  L  S  S  K  P  Q  R  K  R  G  V  K  Q  L  P | |
| 29521 | CAGAACAGTTTGACTCTCTTAATTTAAGTGCTGGTACTCAGCACATTTCAAATGATTTTA | 29580 |
| | Q  N  S  L  T  L  L  I  *  V  L  V  L  S  T  F  Q  M  I  L | |
| | R  T  V  *  L  S  *  F  K  C  W  Y  S  A  H  F  K  *  F  Y | |
| | E  Q  F  D  S  L  N  L  S  A  G  T  Q  H  I  S  N  D  F  T | |
| 29581 | CTCCTGAGGATCATAGTTTACTTGCTACTCTTGATGATCCTTATGTAGAAGACTCTGTTG | 29640 |
| | L  L  R  I  I  V  Y  L  L  L  M  I  L  M  *  K  T  L  L | |
| | S  *  G  S  *  F  T  C  Y  S  *  *  S  L  C  R  R  L  C  C | |
| | P  E  D  H  S  L  L  A  T  L  D  D  P  Y  V  E  D  S  V  A | |
| 29641 | CTTAATGAGAATGAATCCTAATTCGACACTAGGTGGTAACCCCTCGCTATTATTCGGAAT | 29700 |
| | L  N  E  N  E  S  *  F  D  T  R  W  *  P  L  I  I  R  N | |
| | L  M  R  M  N  P  N  S  T  L  G  G  N  P  S  L  L  F  G  I | |
| | *  *  E  *  I  L  I  R  H  *  V  V  T  P  R  Y  Y  S  E  * | |

FIG. 2 CONT'D

```
29701   AGGACACTCTCTATCAGAATGAATTCTTGCTGTAATAACAGATAGAGTAGGTTGTTACAG   29760
          R  T  L  S  I  R  M  N  S  C  C  N  N  R  *  S  R  L  L  Q
         G  H  S  L  S  E  *  I  L  A  V  I  T  D  R  V  G  C  Y  R
          D  T  L  Y  Q  N  E  F  L  L  *  *  Q  I  E  *  V  V  T  D

29761   ACTATATATTAATTAGTAGAAATTTTATATTTAGACATTTGATTGTTAGAGTAGTTATAA   29820
          T  I  Y  *  L  V  E  I  L  Y  L  D  I  *  L  L  E  *  L  *
         L  Y  I  N  *  *  K  F  Y  I  *  T  F  D  C  *  S  S  Y  K
          Y  I  L  I  S  R  N  F  I  F  R  H  L  I  V  R  V  V  I  R

29821   GGTTTAGCTGTAGTATAAACGCCTCCGGGAAGAGCTATCAATTGTAGTGTTTAATATATA   29880
          G  L  A  V  V  *  T  P  P  G  R  A  I  N  C  S  V  *  Y  I
         V  *  L  *  Y  K  R  L  R  E  E  L  S  I  V  V  F  N  I  Y
          F  S  C  S  I  N  A  S  G  K  S  Y  Q  L  *  C  L  I  Y  I

29881   TATTAGTATATGATTGAAATTAATTATAGCCTTTTGGAGGAATTACAAAAAAAAAAAAAA   29940
          Y  *  Y  M  I  E  I  N  Y  S  L  L  E  E  L  Q  K  K  K  K
         I  S  I  *  L  K  L  I  I  A  F  W  R  N  Y  K  K  K  K  K
          L  V  Y  D  *  N  *  L  *  P  F  G  G  I  T  K  K  K  K  K

29941   AA                                                             29942
```

FIG. 2 CONT'D

```
SEQ:   1  CTTATTCTCGCTTAACGCAGGCATGGCAGATAGTCGAATGCTAGAGAACAGTCTAGAGTA   60
             Y  S  R  I  A  D  T  G  D  I  L  K  R  D  R  T  L  D  *
           I  L  A  F  Q  T  R  V  T  *  *  S  V  I  E  Q  *  I  E
          F  L  L  S  N  R  G  Y  R  R  D  A  *  S  R  K  D  S  R  M

61  ATTTAGATTTGAAAAATTTGTTCTAAGGGACAATAGGTACGAACACTCACACCAAATTAG  120
             *  I  *  V  K  *  V  L  N  G  T  I  W  A  Q  S  H  P  K  I
           N  F  R  F  K  K  F  L  I  G  Q  *  G  H  K  H  T  H  N  L
          L  D  L  S  K  L  C  S  E  R  N  D  M  S  T  L  T  T  *  D

121  TATTAGAACATAAAATGAAAGGTGTGAAAAGTAGAGAGACGGTCACTGCACAACCAACAG  180
             M  I  K  Y  K  V  K  W  V  K  *  R  E  A  L  S  T  N  T  T
           *  L  R  T  N  *  K  G  C  K  E  D  R  Q  W  H  R  T  P  Q
          Y  D  Q  I  K  S  E  V  S  K  M  E  R  G  T  V  H  Q  N  D

181  GAGTCGCAGGGAGGGTATCCAGCGTTACTAATTTTGGTCGTTTATGCCAGAGCCGAAGTT  240
             R  L  T  G  G  M  P  R  L  S  *  F  W  C  I  R  D  R  S  *
           G  *  R  G  E  W  L  D  C  H  N  F  G  A  F  V  T  E  A  E
          E  A  D  R  G  Y  T  A  I  I  L  V  L  L  Y  P  R  P  K  L

241  CACCCGCGGTCTTAAAGCAACCGACGAAGGCCTACGTCGCCTCCTCAACCGATCAGGATA  300
             T  P  A  L  I  E  N  A  A  E  P  H  L  P  P  T  P  *  D  *
           L  P  R  W  F  K  T  P  Q  K  R  I  C  R  L  L  Q  S  T  R
          H  A  G  S  N  R  Q  S  S  G  S  A  A  S  S  N  A  L  G  I

301  CTTCAGTCTACTCCCACCCAATACGGGGAGATGACCAGTTCGCTACCTTTCACAACCTAA  360
             S  T  L  H  P  T  I  G  R  *  Q  D  L  S  P  F  H  Q  I
           H  L  *  I  L  T  P  *  A  G  R  S  T  L  R  H  F  T  N  S
          F  D  S  S  P  P  N  H  G  E  V  P  *  A  I  S  L  T  P  N

361  GCAAATACTATTAGTACACTTCTATCTAACAGCGACGTAAGAACCTGTTCTTACCGTACA  420
             R  K  H  Y  D  H  S  S  L  N  D  S  C  E  Q  V  L  I  A  H
           E  N  I  I  I  M  H  L  Y  I  T  A  A  N  K  S  L  F  P  M
          T  *  S  L  *  T  F  I  S  Q  R  Q  M  R  P  C  S  H  C  T

421  CGTCAGTTTAGAATAGGCACTATAAAAACAAGTACTTCTAGATGTACAACATCTTCAAGA  480
             A  T  L  D  *  G  H  Y  K  Q  E  H  L  D  V  H  Q  L  L  E
           H  L  *  I  K  D  T  I  N  K  N  M  F  I  *  M  N  Y  F  N
          C  D  F  R  I  R  S  I  K  T  *  S  S  R  C  T  T  S  T  R

481  TTGATTTTGTCGGCATTTCAGGCCATGCCGTTAAAATTAATTTAGTGGAAACGTATCGAA  540
             L  *  F  L  R  L  T  R  Y  P  L  K  L  *  I  V  K  A  Y  S
           *  S  F  C  G  Y  L  G  T  R  C  N  *  N  F  *  R  Q  M  A
          V  L  V  A  T  F  D  P  V  A  I  K  I  L  D  G  K  C  L  K
```

FIG. 3

```
541  CCCACCAAAAGGATTTCCCATACAATACCCGAACAAGGCAAGTATGTTCTGATTTGCAAT  600
       P  H  N  E  *  L  T  H  *  P  S  T  G  N  M  C  S  *  V  N
        Q  T  T  K  R  F  P  I  N  H  A  Q  E  T  *  V  L  S  F  T
         P  P  K  G  L  P  Y  T  I  P  K  N  R  E  Y  L  V  L  R  *

601  ACAACATGTAGTAGAAAGATACTGATGTAGATGATGATTAAAACCACTTCTAAAAAACCC  660
       H  Q  V  D  D  K  *  S  *  M  *  *  *  N  Q  H  L  N  K  P
        I  N  Y  M  M  K  R  H  S  C  R  S  S  I  K  T  F  I  K  Q
         T  T  C  *  R  E  I  V  V  D  V  V  L  K  P  S  S  K  K  P

661  AACCTAACATGGAAAACCAAAATACGGTAGAATACAAGTGTTTACCAAAGTTAAGACATC  720
       N  S  Q  V  K  Q  N  *  A  M  K  H  E  C  I  T  E  I  R  Y
        T  P  N  Y  R  K  T  K  H  W  R  I  N  V  F  P  K  L  E  T
         Q  I  T  G  K  P  K  I  G  D  *  T  *  L  H  N  *  N  Q  L

721  CAACATATAACTTCTCTCACTAAATTATTAAAGTTTAAAATTTAAACTACTAATACTAAA  780
       T  T  Y  Q  L  S  H  N  L  L  K  L  N  *  I  Q  H  N  H  N
        P  Q  I  N  F  L  T  I  *  Y  N  *  I  K  F  K  I  I  I  I
         N  Y  I  S  S  L  S  K  I  I  E  F  K  L  N  S  S  *  S  K

781  ATCACATCTTCTACGAATACGACTCCAAGTACGACTCGGATTTCCATTTATAAGTGTTTT  840
       *  H  L  L  H  K  H  Q  P  E  H  Q  A  *  L  Y  I  N  V  F
        K  T  Y  F  I  S  I  S  L  N  M  S  L  R  F  T  F  I  *  L
         L  T  S  S  A  *  A  S  T  *  A  S  G  L  P  L  Y  E  C  F

841  TCGAATACGAAATGAATCTGTTATAGCACCATAATTTGGGCATGAAAAACATCTGGTCAT  900
       L  K  H  K  V  *  V  I  D  H  Y  *  V  R  V  K  Q  L  G  T
        F  S  I  S  *  K  S  L  I  T  T  N  F  G  Y  K  K  Y  V  L
         A  *  A  K  S  L  C  Y  R  P  I  L  G  T  S  K  T  S  W  Y

901  ACCAACACTGATAAGACCATTTAATCGTCTAACAGAAGTTCGAATACCAGTAATAAGAAA  960
       H  N  H  S  N  Q  Y  I  L  L  N  D  E  L  K  H  D  N  N  K
        I  T  T  V  I  R  T  F  *  C  I  T  K  L  S  I  T  M  I  R
         P  Q  S  *  E  P  L  N  A  S  Q  R  *  A  *  P  *  *  E  K

961  CGTTCTATACTCTGTTTTCGTCAGACATACCGAACGGTTAACACTGAAACTATAACATCA  1020
       A  L  Y  S  V  F  A  T  Q  I  A  Q  W  N  H  S  Q  Y  Q  L
        Q  L  I  H  S  L  L  L  R  Y  P  K  G  I  T  V  K  I  N  Y
         C  S  I  L  C  F  C  D  T  H  S  A  L  Q  S  K  S  I  T  T

1021 CCGAACCGTACATCAAGCACTAAGTGCTAAACAATACGCGGACGTCTGATATCGATGATA  1080
       P  K  A  H  L  E  H  N  V  I  Q  *  A  G  A  S  *  L  *  *
        H  S  P  M  Y  N  T  I  *  S  K  N  H  A  Q  L  S  Y  S  S
         A  Q  C  T  T  R  S  E  R  N  T  I  R  R  C  V  I  A  V  I
```

FIG. 3 CONT'D

```
1081  AACACCATAATTTATACAACGTGTTGGATGTCTTCTACATCATCTACCTCTACATCAATA  1140
       K  H  Y  *  I  H  Q  V  V  *  L  L  H  L  L  H  L  H  L  *
        N  T  T  N  F  I  N  C  L  R  C  F  I  Y  Y  I  S  I  Y  N
         Q  P  I  L  Y  T  A  C  G  V  S  S  T  T  S  P  S  T  T  I

1141  TGCACTTGGACATGTAAATAATAGACGACTACGTTATCAAAATTTCGAAGGATCAAACTA  1200
       V  H  V  Q  V  N  I  I  Q  Q  H  L  L  K  L  A  E  *  N  S
        Y  T  F  R  Y  M  *  *  R  S  I  C  Y  N  *  L  K  R  T  Q
         R  S  G  T  C  K  N  D  A  S  A  I  T  K  F  S  G  L  K  I

1201  CTTTCAATACTGAGTATACCTACTAAAAAGATAATTTAGATATATATTACAACTAAACAC  1260
       S  L  *  S  E  Y  P  H  N  K  *  *  I  *  I  Y  H  Q  N  T
        H  F  N  H  S  M  H  I  I  K  R  N  F  R  Y  I  I  N  I  Q
         F  T  I  V  *  I  S  S  K  E  I  L  D  I  Y  L  T  S  K  H

1261  ACTAACACCAAAACAATACGTCATACCAATACATCTAACAAAATTACTATTAACACTAAA  1320
       H  N  H  N  Q  *  A  T  H  N  H  L  N  N  *  H  Y  N  H  N
        T  I  T  T  K  N  H  L  I  T  I  Y  I  T  K  I  I  I  T  I
         S  Q  P  K  T  I  C  Y  P  *  T  S  Q  K  L  S  L  Q  S  K

1321  AATACCAACCCAAAGTCCATTATACTACCTACCAAAAAGAACAGGTAACACAACATGTCA  1380
       K  H  N  P  K  L  Y  Y  S  P  H  N  K  K  D  M  T  N  Y  L
        K  I  T  P  N  *  T  I  H  H  I  T  K  R  T  W  Q  T  T  C
         *  P  Q  T  E  P  L  I  I  S  P  K  E  Q  G  N  H  Q  V  T

1381  AATACTGAGATCGCTTCAATTTCGGGTTAGTAGACCACAATAAGGACTTTTAGGACACAA  1440
       K  H  S  *  R  L  *  L  G  I  M  Q  H  *  E  Q  F  D  Q  T
        N  I  V  R  A  F  N  F  G  L  *  R  T  N  N  R  F  I  R  H
         *  S  E  L  S  T  L  A  W  D  D  P  T  I  G  S  F  G  T  N

1441  TAAATGATTATCATGACTATGACAATTGGTACTAAGAAAATTAAACATACCAATAAGACA  1500
       I  *  *  Y  Y  Q  Y  Q  *  G  H  N  K  *  N  T  H  N  N  Q
        *  K  S  I  T  S  I  S  N  V  M  I  R  K  I  Q  I  T  I  R
         N  V  L  L  V  S  V  T  L  W  S  E  K  L  K  Y  P  *  E  T

1501  GTGTGGTAAACCAAGAACATATATAACCAGCGGCGCAGGACCTAACACCTAAGGATATTA  1560
       *  V  M  Q  N  K  Y  I  N  T  A  A  D  Q  I  T  S  E  *  L
        D  C  W  K  T  R  T  Y  I  P  R  R  T  R  S  Q  P  N  R  Y
         V  G  N  P  E  Q  I  Y  Q  D  G  R  G  P  N  H  I  G  I  I

1561  ATTTAGAAGTCAGTTCAGAATACTACTAAACCAAATAAGTCCACATCATCCAACATTTAG  1620
       *  I  K  L  *  T  K  H  H  N  P  K  N  L  H  L  L  N  Y  I
        N  F  R  *  D  L  R  I  I  I  Q  N  I  *  T  Y  Y  T  T  F
         L  D  E  T  L  D  *  S  S  K  T  *  E  P  T  T  P  Q  L  D
```

FIG. 3 CONT'D

```
1621  ATAACAATTTCTTTGACGAGAATAATGAGTACGTGAAATGAATCTAATACAAGTTACATT  1680
         *  Q  *  L  F  Q  E  *  *  E  H  V  K  S  L  N  H  E  I  Y
        R  N  N  F  F  S  S  K  N  S  M  C  K  V  *  I  I  N  L  T
         I  T  L  S  V  A  R  I  V  *  A  S  *  K  S  *  T  *  H  L

1681  CACACCATTAGAACTTGTTTTAGTATAAGAACCGCAATTATTAAGAACCACATCCGTTGA  1740
         T  H  Y  D  Q  V  F  D  Y  E  Q  R  *  Y  N  K  T  Y  A  V
        L  T  T  I  K  F  L  I  M  N  K  A  N  I  I  R  P  T  P  L
         H  P  L  R  S  C  F  *  I  R  P  T  L  L  E  Q  H  L  C  S

1741  CAACGAATTATCTCCACTAATATTATACGAAGATTTTTTATAACTGAACAAACAATTCGC  1800
         T  A  *  Y  L  H  N  Y  Y  A  E  L  F  Y  Q  S  T  Q  *  A
        Q  Q  K  I  S  T  I  I  I  H  K  *  F  I  N  V  Q  K  N  L
         N  S  L  L  P  S  *  L  I  S  R  F  F  I  S  K  N  T  L  R

1801  AGCACGACTAAAACGAACGTTCAAACGTCAAACACCTCTACCAAAACATGGAAAAAATGA  1860
         D  H  Q  N  Q  K  C  T  Q  L  K  H  L  H  N  Q  V  K  K  V
        T  T  S  I  K  S  A  L  K  C  N  T  S  I  T  K  Y  R  K  *
         R  A  S  K  A  Q  L  N  A  T  Q  P  S  P  K  T  G  K  K  S

1861  TCTACCAAATTAAGGGGCATCAATAATAGATTAAGTCTCACCATAAAAGAAATGTAGAAA  1920
         L  H  N  L  E  G  Y  N  N  D  L  E  S  H  Y  K  R  *  M  K
        *  I  T  *  N  G  T  T  I  I  *  N  L  T  T  N  E  K  C  R
         S  P  K  I  G  R  L  *  *  R  I  *  L  P  I  K  K  V  D  K

1921  CTACAGAGTTAAAAGTGTTCTTCAAAGACTATACACAAATTTTTACACATAAAACAAATA  1980
         S  T  E  I  K  V  L  L  K  Q  Y  T  N  L  F  T  Y  K  T  *
        Q  H  R  L  K  *  L  F  N  R  I  H  T  *  F  H  T  N  Q  K
         I  D  *  N  E  C  S  T  E  S  I  H  K  F  I  H  I  K  N  I

1981  CCTGTCTCAAAGTCAACGATGTAAAATATATCTCGTAATACAATTATCCAACCAATGAGT  2040
         P  C  L  K  L  Q  *  M  K  Y  L  A  N  H  *  Y  T  P  *  E
        H  V  S  N  *  N  S  C  K  I  Y  L  M  I  N  I  P  Q  N  S
         S  L  T  E  T  A  V  N  *  I  S  C  *  T  L  L  N  T  V  *

2041  TAAATTCAATAACCCATGATGTGAACAATTATTTTACCAATTAACCAAATTATGGTACAA  2100
         I  *  T  I  P  Y  *  V  Q  *  Y  F  P  *  N  T  *  Y  W  T
        L  K  L  *  Q  T  S  C  K  N  I  F  H  N  I  P  K  I  G  H
         N  L  N  N  P  V  V  S  T  L  L  I  T  L  Q  N  L  V  M  N

2101  TCTACGATCACGTGGACGATGTCCGACCGAAGAAATGGTTAATAACTTACCAGAAAAACA  2160
         L  H  *  H  V  Q  *  L  S  A  E  K  G  I  I  S  H  D  K  Q
        *  I  S  T  C  R  S  C  A  P  K  K  V  L  *  Q  I  T  K  K
         S  A  L  A  G  A  V  P  Q  S  R  *  W  N  N  F  P  R  K  T
```

FIG. 3 CONT'D

```
2161  TCATAGAGTTCGGTTGAAATTAAAACAACGAAATTATGGACTAATACGATTTTAAAATCA  2220
        L  I  E  L  W  S  *  N  Q  Q  K  L  V  Q  N  H  *  F  K  L
         Y  Y  R  L  G  V  K  I  K  N  S  *  Y  R  I  I  S  F  N  *
           T  D  *  A  L  K  L  K  T  A  K  I  G  S  *  A  L  I  K  T

2221  ATTATTTAAAATGTGAAAAAAATTCAATAATAATCTCACACAATGTCAACTACAAAATTT  2280
        *  Y  I  K  C  K  K  *  T  I  I  L  T  H  *  L  Q  H  K  L
         N  I  F  K  V  S  K  K  L  *  *  *  L  T  N  C  N  I  N  *
           L  L  N  *  V  K  K  L  N  N  N  S  H  T  V  T  S  T  K  F

2281  TCTATACGGACAAGAATTTTGATAATTACCAAATCAAACATAACATCCGTTATTCAAAAT  2340
        L  Y  A  Q  E  *  F  *  *  H  N  L  K  Y  Q  L  C  Y  T  K
         F  I  H  R  N  K  F  S  N  I  T  *  N  T  N  Y  A  I  L  K
           S  I  G  T  R  L  V  I  L  P  K  T  Q  I  T  P  L  L  N  *

2341  ATTGCAATCATGTCCCAATTAAGGACCAAAACAAAATGGTACATTACGTGTCCTTGTTGT  2400
        Y  R  *  Y  L  T  L  E  Q  N  Q  K  V  M  Y  H  V  P  V  V
         I  V  N  T  C  P  *  N  R  T  K  N  *  W  T  I  C  L  F  L
           L  T  L  V  P  N  I  G  P  K  T  K  G  H  L  A  C  S  C  C

2401  TTAAATAAAAAAACTTCCGCAACGTCTTAGACAATATCATCTTCTACTACAATAACTCTT  2460
        F  K  N  K  Q  L  R  Q  L  I  Q  *  L  L  L  H  H  *  Q  S
         L  N  I  K  K  F  A  N  C  F  R  N  Y  Y  F  I  I  N  N  L
           I  *  K  K  S  P  T  A  S  D  T  I  T  S  S  S  T  I  S  F

2461  ACAGTTTAGAAGAAATAGTAGAATACTCATAACAGTTGGTGGATTTAGACATCTTTTTTA  2520
        H  *  I  K  K  I  M  K  H  T  N  D  V  V  *  I  Q  L  F  F
         I  D  F  R  R  *  *  R  I  L  I  T  L  W  R  F  R  Y  F  F
           T  L  D  E  K  D  D  *  S  Y  Q  *  G  G  L  D  T  S  F  I

2521  AACATAATATCTATTATACATGTACCCATTCACACCACTATTTAAAAAGGGATAACAGTA  2580
        K  Y  *  L  Y  Y  T  C  P  Y  T  H  H  Y  I  K  G  *  Q  *
         N  T  N  Y  I  I  H  V  H  T  L  T  T  I  F  K  E  R  N  D
           Q  I  I  S  L  I  Y  M  P  L  H  P  S  L  N  K  G  I  T  M

2581  CTTACTATTTTTATAAACAGAAAATCTAGTCCGAACCGCAAAAGGTACACGTCCATCTTT  2640
        S  H  Y  F  Y  K  D  K  L  D  P  K  A  N  E  M  H  L  Y  F
         H  I  I  F  I  N  T  K  *  I  L  S  P  T  K  W  T  C  T  S
           F  S  L  F  I  Q  R  K  S  *  A  Q  R  K  G  H  A  P  L  F

2641  TCAATTAAAAATTGCTCTTTGGACAACAATACCTCTAAGGCAGAAACTACTGTCAATTCCA  2700
        L  *  N  *  R  S  V  Q  Q  *  P  S  E  T  K  S  S  L  *  P
         F  N  I  K  V  L  F  R  N  N  H  L  N  R  R  Q  H  C  N  L
           T  L  K  L  S  F  G  T  T  I  S  I  G  D  K  I  V  T  L  T
```

FIG. 3 CONT'D

```
2701  ATACAAACTAAATCTAAGATGAAAACTACTATAAAATCCATTTCAAACAAGTCTTAAACT  2760
         *  T  Q  N  L  N  *  K  Q  H  Y  K  L  Y  L  K  N  L  I  Q
        N  H  K  I  *  I  R  S  K  I  I  N  *  T  F  N  T  *  F  K
          I  N  S  K  S  E  V  K  S  S  I  K  P  L  T  Q  E  S  N  S

2761  TCATCTTTTCCCACAATGACATCTACTAAAACAACGACAACAAACACTACGATATCTCTT  2820
         L  L  F  P  H  *  Q  L  H  N  Q  Q  Q  K  H  H  *  L  S
        F  Y  F  L  T  N  S  Y  I  I  K  N  S  N  N  T  I  S  Y  L
          T  S  F  P  T  V  T  S  S  K  T  A  T  T  Q  S  A  I  S  F

2821  ACGAAATTTGAGAACATTTCTCGTAGGTCACCAACCAATAGTTCAAGCACGTAAAAATTT  2880
         H  K  L  S  K  Y  L  A  D  L  P  Q  N  D  L  E  H  M  K  L
        I  S  *  V  R  T  F  L  M  W  H  N  T  I  L  N  T  C  K  *
          A  K  F  E  Q  L  S  C  G  T  T  P  *  *  T  R  A  N  K  F

2881  ATTTGAATTACTCTTACAACAAATAAATAAACTACTCCGACCACTACTTCGTTACCGGAG  2940
         Y  V  *  H  S  H  Q  K  N  I  Q  H  P  Q  H  H  L  L  P  R
        I  F  K  I  L  I  N  N  I  *  K  I  L  S  T  I  F  C  H  G
          L  S  L  S  F  T  T  *  K  N  S  S  A  P  S  S  A  I  A  E

2941  AGCATACATAACATGAAAACGATAACTCCTACAACTTCTGCAATAGTCATCACTTCGACA  3000
         E  Y  T  N  Y  K  Q  *  Q  P  H  Q  L  R  *  *  Y  H  L  Q
        R  T  H  I  T  S  K  S  N  L  I  N  F  V  N  D  T  T  F  S
          R  I  Y  Q  V  K  A  I  S  S  T  S  S  T  I  L  L  S  A  T

3001  GCTTCTATGATAACTACCACAGCAACTTCTGTGATAATTACTGCTACTTCTACAACAATG  3060
         R  L  Y  *  Q  H  H  R  Q  L  C  *  *  H  R  H  L  H  Q  *
        D  F  I  S  N  I  T  D  N  F  V  S  N  I  V  I  F  I  N  N
          S  S  V  I  S  P  T  T  S  S  V  I  L  S  S  S  T  T  V

3061  ACCACTGTTACTGCTACTTCTACAACAATGACCACTGTTACTGCTACTTCTACAACAATG  3120
         Q  H  C  H  R  H  L  H  Q  *  Q  H  C  H  R  H  L  H  Q  *
        S  T  V  I  V  I  F  I  N  N  S  T  V  I  V  I  F  I  N  N
          P  S  L  S  S  S  S  T  T  V  P  S  L  S  S  S  S  T  T  V

3121  ACCACTGTTACTGCTACTTCTACAACAATGACCACTGTTACTGCTACTTCTACAACAATG  3180
         Q  H  C  H  R  H  L  H  Q  *  Q  H  C  H  R  H  L  H  Q  *
        S  T  V  I  V  I  F  I  N  N  S  T  V  I  V  I  F  I  N  N
          P  S  L  S  S  S  S  T  T  V  P  S  L  S  S  S  S  T  T  V

3181  ACCACTGTTACTGCTACTTCTACAACAATGACCACTGTTACTGCTACTTCTACAACAATG  3240
         Q  H  C  H  R  H  L  H  Q  *  Q  H  C  H  R  H  L  H  Q  *
        S  T  V  I  V  I  F  I  N  N  S  T  V  I  V  I  F  I  N  N
          P  S  L  S  S  S  S  T  T  V  P  S  L  S  S  S  S  T  T  V
```

FIG. 3 CONT'D

```
3241  ACCACTGTTACTGCTACTTCTACAACAATGACCACTGTTACTGCTACTTCTACAACAATG  3300
        Q  H  C  R  H  L  H  Q  *  Q  H  C  R  H  L  H  Q  *
       S  T  V  I  V  I  F  I  N  N  S  T  V  I  V  I  F  I  N  N
         P  S  L  S  S  S  S  T  T  V  P  S  L  S  S  S  S  T  T  V

3301  ACCACTGTTACTGCTACTTCTACAACAATGACCACTGTTACTGCTACTTCTACAACAATG  3360
        Q  H  C  R  H  L  H  Q  *  Q  H  C  R  H  L  H  Q  *
       S  T  V  I  V  I  F  I  N  N  S  T  V  I  V  I  F  I  N  N
         P  S  L  S  S  S  S  T  T  V  P  S  L  S  S  S  S  T  T  V

3361  ACCACTGTTACTGCTACTTCTACAACAATGACCACTGTTACTGCTACTTCTACAACAATG  3420
        Q  H  C  R  H  L  H  Q  *  Q  H  C  R  H  L  H  Q  *
       S  T  V  I  V  I  F  I  N  N  S  T  V  I  V  I  F  I  N  N
         P  S  L  S  S  S  S  T  T  V  P  S  L  S  S  S  S  T  T  V

3421  ACCACTGTTACTGCTACTTCTACAACAATGACCACTGTTATTGCTACTTCTCTAACAATG  3480
        Q  H  C  R  H  L  H  Q  *  Q  H  C  Y  R  H  L  S  Q  *
       S  T  V  I  V  I  F  I  N  N  S  T  V  I  V  I  F  L  N  N
         P  S  L  S  S  S  S  T  T  V  P  S  L  L  S  S  I  T  V

3481  ACCACTGTTACTACTGGTTTAACAACAATGACCACTACTACATCTACTATAACTTTCATA  3540
        Q  H  C  H  H  G  F  Q  Q  *  Q  H  H  H  L  H  Y  Q  F  Y
       S  T  V  I  I  V  L  N  N  N  S  T  I  I  Y  I  I  N  F  T
         P  S  L  S  S  W  I  T  T  V  P  S  S  T  S  S  I  S  L  I

3541  AATACTGAAACTATGAATATTTCGAGAAAATCAAAAATTACTACAGATATTACTACGAAA  3600
        K  H  S  Q  Y  K  Y  L  E  K  L  K  *  H  H  R  Y  H  H  K
       N  I  V  K  I  S  I  F  S  K  *  N  K  I  I  D  I  I  I  S
         *  S  K  S  V  *  L  A  R  K  T  K  L  S  T  *  L  S  A  K

3601  CAAACAATCAATACCAAGATCACAACTTTGTCTTTGTATAAAATTTCAATTACCAAATAC  3660
        T  Q  *  N  H  N  *  H  Q  F  L  F  M  N  *  L  *  H  N  I
       Q  K  N  T  I  T  R  T  N  F  C  F  C  I  K  F  N  I  T  *
         N  T  L  *  P  E  L  T  S  V  S  V  Y  K  L  T  L  P  K  H

3661  CAGTGGATGATAATGTGTATGATTAACAACCAACGCAAGACACAATGAACATTACGTCTT  3720
        T  V  *  *  *  V  Y  *  N  N  T  A  N  Q  T  V  Q  L  A  S
       P  *  R  S  N  C  M  S  I  T  P  Q  T  R  H  *  K  Y  H  L
         D  G  V  I  V  C  V  L  Q  Q  N  R  E  T  N  S  T  I  C  F

3721  TAATGGAAAATTCAAATTCCTAAATCGATAACTTTTATACACCAATAGAATATTCCACCC  3780
        I  V  K  *  T  *  P  N  L  *  Q  F  Y  T  T  I  K  Y  P  P
       F  *  R  K  L  K  L  I  *  S  N  F  I  H  P  *  R  I  L  H
         N  G  K  L  N  L  S  K  A  I  S  F  I  H  N  D  *  L  T  P
```

FIG. 3 CONT'D

```
3781  AATATTAGTTTCAAAACAACTAATAAATGACTGGTGATAAGGATTTCGATAACAAAACGG  3840
        N  Y  D  F  N  Q  Q  N  N  V  S  W  *  E  *  L  *  Q  K  A
       T  I  I  L  T  K  N  I  I  *  Q  G  S  N  R  F  S  N  N  Q
         *  L  *  L  K  T  S  *  K  S  V  V  I  G  L  A  I  T  K  G

3841  AGTTCCACCAAAACATCGACTAAAACGAATAACCAAAAATTTGGTCAAACTATAATTACG  3900
        E  L  H  N  Q  L  Q  N  Q  K  N  T  K  L  G  T  Q  Y  *  H
       R  L  T  T  K  Y  S  I  K  S  I  P  K  *  V  L  K  I  N  I
         *  P  P  K  T  A  S  K  A  *  Q  N  K  F  W  N  S  I  L  A

3901  CATACGATTAACCACAACAAATTTTACACCAAAAAGAAAACTAAATTTACCAAACCTACG  3960
        T  H  *  N  T  N  N  L  I  H  N  K  K  Q  N  L  H  N  P  H
       R  I  S  I  P  T  T  *  F  T  T  K  R  K  I  *  I  T  Q  I
         Y  A  L  Q  H  Q  K  F  H  P  K  E  K  S  K  F  P  K  S  A

3961  AAACAAAAAAATACCTCTATAACACAGAGTACAAACATTCACACCTGTATTATACTGAGA  4020
        K  T  K  K  H  L  Y  Q  T  E  H  K  Y  T  H  V  Y  Y  S  E
       S  Q  K  K  I  S  I  N  H  R  M  N  T  L  T  S  M  I  H  S
         K  N  K  *  P  S  I  T  D  *  T  Q  L  H  P  C  L  I  V  R

4021  TTATCGTCGCCTGAATGGAACATGTAATGTAAAAGTAATAAACTACTGTTAAAAACACG  4080
        L  L  L  P  S  V  K  Y  M  V  N  K  M  I  Q  H  C  N  K  H
       *  Y  C  R  V  *  R  T  C  *  M  K  *  *  K  I  V  I  K  T
         I  A  A  S  K  G  Q  V  N  C  K  E  N  N  S  S  L  K  Q  A

4081  AAAAACGTGGGGATTTTTTTAAAAATAACGACGTACACGACACCTACATTTGCAAACAGT  4140
        K  K  C  G  *  F  F  K  *  Q  Q  M  H  Q  P  H  L  R  K  D
       S  K  A  G  R  F  F  N  K  N  S  C  T  S  H  I  Y  V  N  T
         K  Q  V  G  L  F  I  K  I  A  A  H  A  T  S  T  F  T  Q  *

4141  AAGACATCGACAATATCCACTACTTGTTTATCTACCATTCAAACAATGATTTAAATCACC  4200
        N  Q  L  Q  *  L  H  H  V  F  L  H  Y  T  Q  *  *  I  *  H
       M  R  Y  S  N  Y  T  I  F  L  Y  I  T  L  K  N  S  F  K  T
         E  T  A  T  I  P  S  S  C  I  S  P  L  N  T  V  L  N  L  P

4201  ACTATTTAAACTAAAATATCATCCAATACCTTACAGTAAATCATACAGAAGAAAACTCAA  4260
        H  Y  I  Q  N  *  L  L  N  H  F  T  M  *  Y  T  K  K  Q  T
       T  I  F  K  I  K  Y  Y  T  I  S  H  *  K  T  H  R  R  K  L
         S  L  N  S  K  I  T  P  *  P  I  D  N  L  I  D  E  K  S  N

4261  TGGAGTTAACATACCAAACACATATTGTGGATTACATACAAAACAATTTCCACTATAATA  4320
        V  E  I  T  H  N  T  Y  L  V  *  H  I  N  Q  *  L  H  Y  *
       *  R  L  Q  I  T  Q  T  Y  C  R  I  Y  T  K  N  F  T  I  N
         G  *  N  Y  P  K  H  I  V  G  L  T  H  K  T  L  P  S  I  I
```

FIG. 3 CONT'D

```
4321  TTTACAACGATCTGAACAATTTCGACTACAATAACAATTAGGACGATTACCCGTATACGA  4380
        L  H  Q  *  V  Q  *  L  Q  H  *  Q  *  D  Q  *  H  A  Y  A
         Y  I  N  S  S  K  N  F  S  I  N  N  N  I  R  S  I  P  M  H
           F  T  A  L  S  T  L  A  S  T  I  T  L  G  A  L  P  C  I  S

4381  GGTACCACCACCTCAACGTTTTCGATATCGACATCGACGTCCATTTTTTAAAAGATTTCT  4440
        G  H  H  H  L  Q  L  L  *  L  Q  L  Q  L  Y  F  I  K  *  L
         E  M  T  T  S  N  C  F  S  Y  S  Y  S  C  T  F  F  K  R  F
           W  P  P  P  T  A  F  A  I  A  T  A  A  P  L  F  N  E  L  S

4441  TTGACGACGATACCAATTTAGATTTCCACAAACGGTTCATCCTCTAACAATACAAAGATG  4500
        F  Q  Q  *  P  *  I  *  L  H  K  G  L  L  L  N  N  H  K  *
         F  S  S  S  H  N  F  R  F  T  N  A  L  Y  S  I  T  I  N  R
           V  A  A  I  T  L  D  L  P  T  Q  W  T  P  S  Q  *  T  E  V

4501  GCCACCATTTAATACATTTTGTTAAGAATTATAACATCCGGGACTACGATCTGTTCTACC  4560
        R  H  Y  I  I  Y  F  L  E  *  Y  Q  L  G  Q  H  *  V  L  H
         G  T  T  F  *  T  F  C  N  K  I  N  Y  A  R  I  S  S  L  I
           P  P  L  N  H  L  V  I  R  L  I  T  P  G  S  A  L  C  S  P

4561  TTCTGTTAGAATACAAAACAATCGTGCACGAATATTCGTAGAATTATTAATACTAACAAC  4620
        F  V  I  K  H  K  T  L  V  H  K  Y  A  D  *  Y  N  H  N  N
         S  S  L  R  I  N  Q  *  C  T  S  I  L  M  K  I  I  I  I  T
           L  C  D  *  T  K  N  A  R  A  *  L  C  R  L  L  *  S  Q  Q

4621  AAACAGATGAGAGTATAGCCGACCATATAAATCACAAGGACGACTACACAGTAATTGAAT  4680
        N  T  *  E  *  I  P  Q  Y  I  *  H  E  Q  Q  H  T  M  L  K
         T  Q  R  S  E  Y  R  S  T  Y  K  T  N  R  S  I  H  *  *  S
           K  D  V  R  M  D  A  P  I  N  L  T  G  A  S  T  D  N  V  *

4681  GGAAGATCCACAACAACTATTTGTTCAATAGGAACAATCATTATTATTTCTTCTAAAACT  4740
        G  E  L  H  Q  Q  Y  V  L  *  G  Q  *  Y  Y  Y  L  L  N  Q
         V  K  *  T  N  N  I  F  L  N  D  K  N  T  I  I  F  F  I  K
           R  R  P  T  T  S  L  C  T  I  R  T  L  L  L  L  S  S  K  S

4741  ATAATAAGTTTTTACAGTTTAATGAAGTCAACAACCATGATTTCGTAACCGACAATCTAA  4800
        Y  *  E  F  I  D  F  *  K  L  Q  Q  Y  *  L  M  P  Q  *  I
         I  N  N  L  F  T  L  N  S  *  N  N  T  S  F  C  Q  S  N  S
           I  I  *  F  H  *  I  V  E  T  T  P  V  L  A  N  A  T  L  N

4801  TTGACGATTACATCCGGCACAATAATTTAAACTCTGTCTACGTATGTTTGAAAAAACTC  4860
        L  Q  *  H  L  G  H  *  *  I  Q  S  L  H  M  C  V  K  K  S
         *  S  S  I  Y  A  T  N  N  F  K  L  C  I  C  V  F  K  K  Q
           V  A  L  T  P  R  T  I  L  N  S  V  S  A  Y  L  S  K  K  L
```

FIG. 3 CONT'D

```
4861  ACCACTACTAACAAAACAAAGTTTAAGAAGACAATATGTTCTTCAAAATAACGAAGCAGT  4920
        H  H  H  N  Q  K  L  N  K  Q  *  V  L  L  K  I  A  E  D
       T  T  I  I  T  K  N  *  I  R  R  N  Y  L  F  N  *  Q  K  T
          P  S  S  Q  K  T  E  F  E  E  T  I  C  S  T  K  N  S  R  *

4921  ACTATATGTTAACTTATTACTGCAAGCACTAATAAACAACAGATTCTACTGATCAGAAGG  4980
        H  Y  V  I  S  Y  H  R  E  H  N  N  T  T  *  S  S  *  D  E
       M  I  Y  L  Q  I  I  V  N  T  I  I  Q  Q  R  L  H  S  T  K
          S  I  C  N  F  L  S  T  R  S  *  K  N  D  L  I  V  L  R  G

4981  ATTTCTAACCGCAGAATAGTTATTTAAACTACAATAATTGCCACAATTTTGACAATTCAT  5040
        *  L  N  A  D  *  *  Y  I  Q  H  *  *  R  H  *  F  Q  *  T
       R  F  I  P  T  K  D  I  F  K  I  N  N  V  T  N  F  S  N  L
          L  S  Q  R  R  I  L  L  N  S  T  I  L  P  T  L  V  T  L  Y

5041  AAAACTCACAGGATTAAGATAAATATATACATCAGTCCCATTTCTGAAACCAATACATAC  5100
        N  Q  T  D  *  N  *  K  Y  I  Y  D  P  Y  L  S  Q  N  H  I
       I  K  L  T  R  I  R  N  I  Y  T  T  L  T  F  V  K  T  I  Y
          K  S  H  G  L  E  I  *  I  H  L  *  P  L  S  K  P  *  T  H

5101  ACTACCAAGAAAAATATTTCGTTGACAATTAGTTCAAACACAAAATAATCGATTCTTCTA  5160
        H  H  N  K  K  Y  L  L  Q  *  D  L  K  H  K  I  L  *  S  S
       T  I  T  R  K  I  F  C  S  N  I  L  N  T  N  *  *  S  L  L
          S  P  E  K  *  L  A  V  T  L  *  T  Q  T  K  N  A  L  F  I

5161  TCTACAAAACGAATGACATCTACCACAATTAAAATTTAGATAAAGAGAATGACATCCACT  5220
        L  H  K  A  *  Q  L  H  H  *  N  *  I  *  K  E  *  Q  L  H
       Y  I  N  Q  K  S  Y  I  T  N  I  K  F  R  N  R  K  S  Y  T
          S  T  K  S  V  T  S  P  T  L  K  L  D  I  E  R  V  T  P  S

5221  TCAAAAACCATTTTATGAACCATTACAAAAGACACTACCGTAACTACAATGATTCAATTT  5280
        L  K  Q  Y  F  V  Q  Y  H  K  R  H  H  C  Q  H  *  *  T  L
       F  N  K  T  F  Y  K  T  I  N  E  T  I  A  N  I  N  S  L  *
          T  K  P  L  I  S  P  L  T  K  Q  S  P  M  S  T  V  L  N  F

5281  CACATCACTAAAAATACGGCTATTTTAAAATATAGTCATACTTTTAAACAGAAATCGACT  5340
        T  Y  H  N  K  H  R  Y  F  K  I  D  T  H  F  N  T  K  L  Q
       L  T  T  I  K  I  G  I  F  N  *  I  L  I  F  I  Q  R  *  S
          H  L  S  K  *  A  S  L  I  K  Y  *  Y  S  F  K  D  K  A  S

5341  ATAAAGACGACATGTTTCAAGTAAACCCAAACTAGTCGTTGTTAACGAACGAATAATATT  5400
        Y  K  Q  Q  V  F  N  M  Q  T  Q  D  A  V  I  A  Q  K  N  Y
       I  N  R  S  Y  L  T  *  K  P  K  I  L  L  L  Q  K  S  I  I
          I  E  A  T  C  L  E  N  P  N  S  *  C  C  N  S  A  *  *  L
```

FIG. 3 CONT'D

```
5401  AAAAAATTGTCATACATTTACCAGACATCAACAATTGCCAGGTAAAAAAAGAAAACTTGT  5460
       N  K  L  L  I  Y  I  T  Q  L  Q  *  R  D  M  K  K  K  Q  V
        I  K  *  C  Y  T  F  P  R  Y  N  N  V  T  W  K  K  R  K  F
         K  K  V  T  H  L  H  D  T  T  T  L  P  G  N  K  E  K  S  C

5461  CAGAGTATTATTAACAATACACTTACATCGAACAGAATACAACGTCGTATAATTAGAATT  5520
       T  E  Y  Y  N  N  H  S  H  L  K  D  *  T  A  A  Y  *  D  *
        L  R  M  I  I  T  I  H  I  Y  S  T  K  H  Q  L  M  N  I  K
         D  *  L  L  Q  *  T  F  T  A  Q  R  I  N  C  C  I  L  R  L

5521  TAAATTATTTACCGTCACCGTCCTTCGTACCATACTTAAAGCACGACCGTCTGGTGTATC  5580
       I  *  Y  I  A  T  A  P  L  M  T  H  I  E  H  Q  C  V  V  Y
        F  K  I  F  P  L  P  L  F  C  P  I  F  K  T  S  A  S  W  M
         N  L  L  H  C  H  C  S  A  H  Y  S  N  R  A  P  L  G  C  L

5581  CAATCAACGAGAACAAAATCGATTTCCAGTAAAATTTAAACTACTTGGTAGTCTACGATG  5640
       T  L  Q  E  Q  K  L  *  L  D  N  *  I  Q  H  V  M  L  H  *
        P  *  N  S  K  N  *  S  F  T  M  K  F  K  I  F  W  *  I  S
         N  T  A  R  T  K  A  L  P  *  K  L  N  S  S  G  D  S  A  V

5641  ACTAAAATAAGCACAACAAAACTTTGTTCGACTAAATAGTCCACGTTAAACACTTAATCT  5700
       Q  N  *  E  H  Q  K  S  V  L  Q  N  I  L  H  L  K  H  I  L
        S  I  K  N  T  N  N  Q  F  L  S  I  *  *  T  C  N  T  F  *
         S  K  I  R  T  T  K  F  C  A  S  K  D  P  A  I  Q  S  N  S

5701  TGAATAAACACTAACACCATAATTTGTTCTTTCAGCACAACCACAACTACGACAATACGT  5760
       V  *  K  H  N  H  Y  *  V  L  F  D  H  Q  H  Q  H  Q  *  A
        F  K  N  T  I  T  T  N  F  L  F  T  T  N  T  N  I  S  N  H
         S  I  Q  S  Q  P  I  L  C  S  L  R  T  P  T  S  A  T  I  C

5761  AAAACCATGTAATCGTTTCTGACTAGAAAAATTACCAATATTCTAACCGACATTAACACG  5820
       N  Q  Y  M  L  L  S  Q  D  K  *  H  N  Y  S  Q  S  Y  N  H
        M  K  T  C  *  C  L  S  I  K  K  I  T  I  L  N  A  T  I  T
         K  P  V  N  A  F  V  S  R  K  L  P  *  L  I  P  Q  L  Q  A

5821  TCCATCTTAACAGGTAACATGATTTAACTTACATGGTAAAAACTAAACAAGATTATGAGG  5880
       L  Y  F  Q  G  N  Y  *  I  S  H  V  M  K  S  K  N  *  Y  E
        C  T  S  N  D  M  T  S  F  Q  I  Y  W  K  Q  N  T  R  I  S
         P  L  I  T  W  Q  V  L  N  F  T  G  N  K  I  Q  E  L  V  G

5881  AGACTCATTCCTAAATGGACTACTACAACAACGTCGATTGTACAAATACCCACATCCACA  5940
       E  S  Y  P  N  V  Q  H  H  Q  Q  L  *  C  T  *  P  H  L  H
        R  Q  T  L  I  *  R  I  I  N  N  C  S  V  H  K  H  T  Y  T
         R  L  L  S  K  G  S  S  T  T  A  A  L  M  N  I  P  T  P  T
```

FIG. 3 CONT'D

```
5941  TCCGGTAATATGTGTAAACTTTACACCAAGTGGAATGGTTGTAATACTACGAACATCACA  6000
        L  G  N  Y  V  N  S  I  H  N  V  K  G  V  N  H  H  K  Y  H
         Y  A  M  I  C  M  Q  F  T  T  *  R  V  L  M  I  I  S  T  T
          P  W  *  V  C  K  F  H  P  E  G  *  W  C  *  S  A  Q  L  T

6001  ATTTTTTATATGTCCACAATCACCAACAAATTGACTGACGAACATAGAATTTTTAAATTG  6060
        *  F  I  Y  L  H  *  H  N  N  L  Q  S  S  T  D  *  F  N  L
         N  F  F  I  C  T  N  T  T  T  *  S  V  A  Q  I  K  F  I  *
          L  F  Y  V  P  T  L  P  Q  K  V  S  Q  K  Y  R  L  F  K  V

6061  GGTCTGAAAATGTAGATACAACTGATTAATAAAAAACCTACTACAACTTTACCAACGAAT  6120
        G  S  K  *  M  *  T  S  *  N  N  K  P  H  H  Q  F  P  Q  K
         G  L  S  K  C  R  H  Q  S  I  I  K  Q  I  I  N  F  H  N  S
          W  V  K  V  D  I  N  V  L  *  K  K  S  S  T  S  I  T  A  *

6121  ATTGGGACTAGAAAGTGTTATAATAACACTATTACCATTCATAATATGTTTTGGATAATA  6180
        Y  G  Q  D  K  V  I  N  N  H  Y  H  Y  T  N  Y  L  V  *  *
         I  V  R  I  K  *  L  I  I  T  I  I  T  L  I  I  C  F  R  N
          L  G  S  R  E  C  Y  *  Q  S  L  P  L  Y  *  V  F  G  I  I

6181  TTTCCGAGTCAAATTTGGTAAACGATTTCAACTGCCACAAATATGATTGAAATTCAATCA  6240
        L  P  E  T  *  V  M  Q  *  L  Q  R  H  K  Y  *  S  *  T  L
         Y  L  S  L  K  F  W  K  S  F  N  V  T  N  I  S  V  K  L  *
          F  A  *  N  L  G  N  A  L  T  S  P  T  *  V  L  K  L  N  T

6241  ACCTGTACTATAAACACGAGTTAACTTACTATTCAATCCAAAATTACATCTAAACGGCAA  6300
        Q  V  H  Y  K  H  E  I  S  H  Y  T  L  N  *  H  L  N  A  T
         N  S  M  I  N  T  S  L  Q  I  I  L  *  T  K  I  Y  I  Q  R
          P  C  S  I  Q  A  *  N  F  S  L  N  P  K  L  T  S  K  G  N

6301  ACAACTCATGTTTCATTGTCAGACCGGACATCGATGACCACTACAACAAAACCGTAGACT  6360
        Q  Q  T  C  L  L  L  R  Q  L  *  Q  H  H  Q  K  P  M  Q
         K  N  L  V  F  Y  C  D  P  R  Y  S  S  T  I  N  N  Q  C  R
          T  S  Y  L  T  V  T  Q  G  T  A  V  P  S  T  T  K  A  D  S

6361  ACTAAATATACACTTTGCAATAAAATTTCCTACACTTTGAAAACCATTCGGACAATAAAC  6420
        H  N  I  H  S  V  N  N  *  L  I  H  F  K  Q  Y  A  Q  *  K
         I  I  *  I  H  F  T  I  K  F  S  T  F  S  K  T  L  R  N  N
          S  K  Y  T  F  R  *  K  L  P  H  S  V  K  P  L  G  T  I  Q

6421  CAAAACAGTACTACTTCGTAGTAACTTAAGAGAATGAATAAAATTATTTGGATCAAAATT  6480
        T  K  D  H  H  L  M  M  S  N  E  *  K  N  *  Y  V  *  N  *
         P  K  T  M  I  F  C  *  Q  I  R  K  S  I  K  I  F  R  T  K
          N  Q  *  S  S  A  D  N  F  E  R  V  *  K  L  L  G  L  K  L
```

FIG. 3 CONT'D

```
6481  TAGACTTTTATCTATATCACAAAACAGACAACTAAGACATAGACTCCTCAGTGTTCCATT  6540
        I  Q  F  Y  I  Y  H  K  T  Q  Q  N  Q  I  Q  P  T  V  L  Y
       F  R  F  I  S  I  T  N  Q  R  N  I  R  Y  R  L  L  *  L  T
         D  S  F  L  Y  L  T  K  D  T  S  E  T  D  S  S  D  C  P  L

6541  ACACCAATGAAGACAATACCTTAGCGTCTAATCATGATTTCTCCAATTCAATTTCCCACA  6600
        H  P  *  K  Q  *  P  I  A  S  *  Y  *  L  P  *  T  L  P  H
       I  H  N  S  R  N  H  F  R  L  N  T  S  F  L  N  L  *  L  T
         T  T  V  E  T  I  S  D  C  I  L  V  L  S  T  L  N  F  P  T

6601  ATCTTTCTGACAATTTTATCTTCTACGATAATAACAATTACTACTTTTATCAAGATAATT  6660
        *  F  S  Q  *  F  L  L  H  *  *  Q  *  H  H  F  Y  N  *  *
       N  S  L  S  N  F  Y  F  I  S  N  N  N  I  I  F  I  T  R  N
         L  F  V  T  L  I  S  S  A  I  I  T  L  S  S  F  L  E  I  L

6661  CCAACAATTTTCAAATAGAAATCAACTACAAACCCTATACATAAACTGTCCAACACTAAT  6720
        P  Q  *  F  N  I  K  L  Q  H  K  P  Y  T  N  S  L  N  H  N
       L  N  N  F  T  *  R  *  N  I  N  P  I  H  I  Q  C  T  T  I
         T  T  L  L  K  D  K  T  S  T  Q  S  I  Y  K  V  P  Q  S  *

6721  ACAACAAACCCAACGATTACTTAACAGTGCGGATCAATTTAGTGGTTGTCAATCCCTTAT  6780
        H  Q  K  P  Q  *  H  I  T  V  G  L  *  I  V  L  L  *  P  I
       I  N  N  P  N  S  I  F  Q  *  A  *  N  F  *  W  C  N  P  F
         T  T  Q  T  A  L  S  N  D  R  R  T  L  D  G  V  T  L  S  Y

6781  ATATGCTATACCATAATTTGGATAATGATATGGATATCTAAACAATACAAATTCTCTACT  6840
        Y  V  I  H  Y  *  V  *  *  *  V  *  L  N  T  I  N  L  L  H
       I  Y  S  I  T  N  F  R  N  S  Y  R  Y  I  Q  *  T  *  S  I
         I  R  Y  P  I  L  G  I  V  I  G  I  S  K  N  H  K  L  S  S

6841  ATTAGTTTGAGAAAATCAAGGATTTTAAAAATTTCGTTCTCGATATCTTAAAATACCAAA  6900
        Y  D  F  E  K  L  E  *  F  K  *  L  L  L  *  L  I  K  H  N
       I  I  L  S  K  *  N  R  F  N  K  F  C  S  S  Y  F  K  I  T
         L  *  V  R  K  T  G  L  I  K  L  A  L  A  I  S  N  *  P  K

6901  AAACTTCACCAACAAATAAATACAAAAATCAAATAATGTAAAATGTTTACTATTTTGGTA  6960
        K  S  T  T  T  *  K  H  K  *  N  I  V  N  *  L  H  Y  F  W
       K  Q  L  P  Q  K  N  I  N  K  T  *  *  M  K  C  I  I  F  G
         K  F  H  N  N  I  *  T  K  L  K  N  C  K  V  F  S  L  V  M

6961  AAAAATATGATGTCTTTATCGAAGATTCAAATGAAAATTAAACAAAACAAACCGAGAATT  7020
        K  K  Y  *  L  F  L  K  *  T  *  K  *  N  T  K  N  P  E  *
       N  K  I  S  C  F  Y  S  R  L  K  S  K  I  Q  K  T  Q  S  K
         K  *  V  V  S  I  A  E  L  N  V  K  L  K  N  Q  K  A  R  L
```

FIG. 3 CONT'D

```
7021  TTTACGAAAAGTCTGTAAATCTACCTCATATAAATATTTTCCAAAAGAACAACATCGGTG  7080
        F  H  K  E  S  M  *  I  S  Y  I  *  L  L  N  E  Q  Q  L  W
       F  I  S  K  L  C  K  S  P  T  Y  K  Y  F  T  K  K  N  Y  G
         F  A  K  *  V  N  L  H  I  N  I  F  P  K  R  T  T  A  V

7081  ACACAAAAACAAAACCAAATTAAAAAACATATATTTACAATAAAAATCACTGAAAATAGA  7140
        Q  T  K  T  K  T  *  N  K  T  Y  L  H  *  K  *  H  S  K  D
       S  H  K  Q  K  P  K  I  K  Q  I  Y  I  N  N  K  T  V  K  I
         T  N  K  N  Q  N  L  K  K  Y  I  F  T  I  K  L  S  K  *  R

7141  AGGATTATAATCACAAAAAGGATAAAAACACCCTTCTTAACAATACACCTATTTCCGATG  7200
        E  *  Y  *  H  K  E  *  K  Q  P  F  F  Q  *  T  S  L  P  *
       K  R  I  N  T  N  K  R  N  K  H  S  S  N  N  H  P  Y  L  S
         G  L  I  L  T  K  G  I  K  T  P  L  I  T  I  H  I  F  A  V

7201  AAAACCAAACCAATGTTAAACACTAAAAATAAGATTCAATCCACATCCAAAATGTTCAGT  7260
        K  Q  N  P  *  L  K  H  N  K  N  *  T  L  H  L  N  *  L  D
       S  K  T  Q  N  C  N  T  I  K  I  R  L  *  T  Y  T  K  C  T
         K  P  K  T  V  I  Q  S  K  *  E  L  N  P  T  P  K  V  L  *

7261  AAAAACATTACCATCAAAATATACACTTAACACAGTAAGACCAAAACTATACAACCTATG  7320
        N  K  Y  H  Y  N  *  I  H  I  T  D  N  Q  N  Q  Y  T  P  Y
       M  K  T  I  T  T  K  Y  T  F  Q  T  M  R  T  K  I  H  Q  I
         K  Q  L  P  L  K  I  H  S  N  H  *  E  P  K  S  I  N  S  V

7321  TATACGTCGATATCTAAAACAAGTCATACTTCATCTATCTGCACAAAATAAACTAATACA  7380
        M  H  L  *  L  N  Q  E  T  H  L  L  Y  V  H  K  I  Q  N  H
       C  I  C  S  Y  I  K  N  L  I  F  Y  I  S  T  N  *  K  I  I
         Y  A  A  I  S  K  T  *  Y  S  T  S  L  R  T  K  N  S  *  T

7381  ATCAAATCAGTTTAATTAACAACTTGAGCAATAACCAATAAGTAATATGTGTCATACCAA  7440
        *  N  L  *  I  L  Q  Q  V  R  *  Q  N  N  M  I  C  L  I  T
       N  T  *  D  F  *  N  N  F  E  N  N  T  I  *  *  V  C  Y  P
         L  K  T  L  N  I  T  S  S  T  I  P  *  E  N  Y  V  T  H  N

7441  AATAGGTAATAAAACAGAATAACCAAATGTTAATAAATGATGTACCAACGGACTAAACAA  7500
        K  D  M  I  K  D  *  Q  N  V  I  I  *  *  M  T  A  Q  N  T
       K  I  W  *  K  T  K  N  T  *  L  *  K  S  C  P  Q  R  I  Q
         *  G  N  N  Q  R  I  P  K  C  N  N  V  V  H  N  G  S  K  N

7501  ATACAATCTTTGATACGTAACCAACTAATCTAAATAACATAAACATCGATTATACAATGG  7560
        *  T  L  F  *  A  N  T  S  *  I  *  Q  I  Q  L  *  Y  T  V
       K  H  *  F  S  H  M  P  Q  N  S  K  N  Y  K  Y  S  I  H  *
         I  N  S  V  I  C  Q  N  I  L  N  I  T  N  T  A  L  I  N  G
```

FIG. 3 CONT'D

```
7561  ACGAAAACAGAACAACGCCAAAATATATCAACAATGACGATACATATTTCATCAACCAAA  7620
       Q  K  Q  R  T  A  T  K  Y  L  Q  *  Q  *  T  Y  L  L  Q  N
      R  S  K  D  Q  Q  P  K  I  Y  N  N  S  S  H  I  F  Y  N  T
        A  K  T  K  N  R  N  *  I  T  T  V  A  I  Y  L  T  T  P  K

7621  ATAATCCGTATAACAGATACCAACATTATTTCGACCAACAAATAAAACAATATTTGCTTT  7680
       *  *  A  Y  Q  R  H  N  Y  Y  L  Q  N  N  I  K  N  Y  V  F
      K  N  P  M  N  D  I  T  T  I  F  S  T  T  *  K  T  I  F  S
        I  L  C  I  T  *  P  Q  L  L  A  P  Q  K  N  Q  *  L  R  F

7681  AACATCACAAGCACAATTCACATCATGATAACAACCACCACATTAAGCAATAATACTATA  7740
       N  Y  H  E  H  *  T  Y  Y  *  Q  Q  H  H  L  E  N  N  H  Y
      I  T  T  N  T  N  L  T  T  S  N  N  T  T  Y  N  T  I  I  I
        Q  L  T  R  T  L  H  L  V  I  T  P  P  T  I  R  *  *  S  I

7741  ATGACGATTACCACCATGACCAAAAACACAATTTGTAGTTACCTTAACAAAATTAACGGT  7800
       *  Q  *  H  H  Y  Q  N  K  H  *  V  D  I  S  N  N  *  N  G
      N  S  S  I  T  T  S  T  K  T  N  F  M  L  P  I  T  K  I  A
        V  A  L  P  P  V  P  K  Q  T  L  C  *  H  F  Q  K  L  Q  W

7801  AAGAAAATTTGGTCCATTGTGAAAATATTGACATCTTCGACGATATCTTGAAAGATTTCT  7860
       N  K  *  V  L  Y  C  K  *  L  Q  L  L  Q  *  L  V  K  *  L
      M  R  K  F  W  T  V  S  K  Y  S  Y  F  S  S  Y  F  K  R  F
        E  K  L  G  P  L  V  K  I  V  T  S  A  A  I  S  S  E  L  S

7861  CGAATTTGCTGGACATTTAGGTTGACTACGAAGTGTAATACATCAATGACTATAATTCGT  7920
       A  *  V  V  Q  L  D  L  Q  H  K  V  N  H  L  *  Q  Y  *  A
      L  K  F  S  R  Y  I  W  S  I  S  *  M  I  Y  N  S  I  N  L
        S  L  R  G  T  F  G  V  S  A  E  C  *  T  T  V  S  I  L  C

7921  TCAACCAACATACTACGCAAACAAGATACTATCTCTACCTGTCGCACAAATGCTACTACA  7980
       L  Q  N  Y  S  A  N  T  R  H  Y  L  H  V  A  H  K  R  H  H
      L  N  T  T  H  H  T  Q  E  I  I  S  I  S  L  T  N  V  I  I
        T  P  Q  I  I  R  K  N  *  S  L  S  P  C  R  T  *  S  S  T

7981  ACTACGATCAAATAAACATCTATAATTATTAGACAATGTAAGATTTCAATTTCAACAAGG  8040
       Q  H  *  N  I  Q  L  Y  *  Y  D  T  V  N  *  L  *  L  Q  E
      N  I  S  T  *  K  Y  I  N  I  I  Q  *  M  R  F  N  F  N  N
        S  A  L  K  N  T  S  I  L  L  R  N  C  E  L  T  L  T  T  G

8041  ATTAAACATACATCAACATCATCTCTCACTACGACTATCTCGATTAAAAGACTTACGACA  8100
       *  N  T  H  L  Q  L  L  S  H  H  Q  Y  L  *  N  E  S  H  Q
      R  I  Q  I  Y  N  Y  Y  L  T  I  S  I  S  S  I  K  Q  I  S
        L  K  Y  T  T  T  T  T  S  L  S  A  S  L  A  L  K  R  F  A  T
```

FIG. 3 CONT'D

```
8101  ACACAAAATACGTGTTAGTAACATATCCGGATATAATGAACATCTGTTTTTCAATTAATG  8160
         Q  T  K  H  V  I  M  T  Y  A  *  I  V  Q  L  C  F  T  L  *
        N  H  K  I  C  L  *  Q  I  P  R  Y  *  K  Y  V  F  L  *  N
         T  N  *  A  C  D  N  Y  L  G  I  N  S  T  S  L  F  N  I  V

8161  ATGTCGAACATTACCATAGAGACATTGGGTCTGATACAAACTACAAATACAACTATGAAA  8220
         *  L  K  Y  H  Y  R  Q  L  G  S  *  T  Q  H  K  H  Q  Y  K
         S  C  S  T  I  T  D  R  Y  G  L  S  H  K  I  N  I  N  I  S
         V  A  Q  L  P  I  E  T  V  W  V  I  N  S  T  *  T  S  V  K

8221  ATACAGAGTAAAACTACAACTATCTTTCTCAAAATTATTAAAACAATTGTAACGAGTACG  8280
         *  T  E  N  Q  H  Q  Y  F  S  N  *  Y  N  Q  *  C  Q  E  H
         K  H  R  M  K  I  N  I  S  L  T  K  I  I  K  N  V  N  S  M
         I  D  *  K  S  T  S  L  F  L  K  L  L  K  T  L  M  A  *  A

8281  AAGAGAATCTCTCCCACACGTTAATCTTTTCCAAAATCTATGAAAACACCCTACACATGC  8340
         K  E  *  L  P  H  A  I  L  F  P  K  L  Y  K  Q  P  I  H  V
         S  R  K  S  L  T  H  L  *  F  L  N  *  I  S  K  H  S  T  Y
         E  R  L  S  P  T  C  N  S  F  T  K  S  V  K  T  P  H  T  R

8341  ATTTACAACAAGGTAACTAAGTCTACAACTTTGTTCTAAATAATGATTTAGATACTATAG  8400
         Y  I  N  N  W  Q  N  L  H  Q  F  L  I  *  *  *  I  *  S  I
         T  F  T  T  G  N  I  *  I  N  F  C  S  K  N  S  F  R  H  Y
         L  H  Q  E  M  S  E  S  T  S  V  L  N  I  V  L  D  I  I  D

8401  ACGTCATCGACGACCAAACCTTAAATGACTACTTTTAATATTGTTAAACCATGGATGTAT  8460
         Q  L  L  Q  Q  N  P  I  *  Q  H  F  N  Y  C  N  P  V  *  M
         R  C  Y  S  S  T  Q  F  K  S  I  F  I  I  V  I  Q  Y  R  C
         A  T  A  A  P  K  S  N  V  S  S  F  *  L  L  K  T  G  V  Y

8461  AAATTTCTCACTATTATAACATCGACGACTAAATCCACAAGAATATGTCTTACCACGATT  8520
         N  L  S  H  Y  Y  Q  L  Q  Q  N  L  H  E  *  V  S  H  H  *
         I  *  L  T  I  I  N  Y  S  S  I  *  T  N  K  Y  L  I  T  S
         K  F  L  S  L  I  T  A  A  S  K  P  T  R  I  C  F  P  A  L

8521  CGTACATGTCCCATTACAACGATTCCGTCGATTATAAAGAACATATACCAAATAACTACG  8580
         A  H  V  P  Y  H  Q  *  P  L  *  Y  K  K  Y  I  T  *  Q  H
         L  M  Y  L  T  I  N  S  L  C  S  I  N  R  T  Y  P  K  N  I
         C  T  C  P  L  T  A  L  A  A  L  I  E  Q  I  H  N  I  S  A

8581  AAAATTAGTTGAATGACGACTAAATGTCGTATTTAATTTTTTTCGTACACAATTTTGACC  8640
         K  *  D  V  *  Q  Q  N  V  A  Y  I  L  F  L  M  H  *  F  Q
         S  K  I  L  K  S  S  I  *  L  M  F  *  F  F  C  T  N  F  S
         K  L  *  S  V  A  S  K  C  C  L  N  F  F  A  H  T  L  V  P
```

FIG. 3 CONT'D

```
8641  GAACTTCAATTTTAACTGAAAATTATTCGTTCTCCGTTCACAGGGATAAGAATGTTGTGG  8700
        S  S  T  L  I  S  K  *  Y  A  L  P  L  H  G  *  E  *  L  V
       A  Q  L  *  F  Q  S  K  I  L  L  L  C  T  D  R  N  K  C  C
         K  F  N  F  N  V  K  L  L  C  S  A  L  T  G  I  R  V  V  G

8701  GAAAAGTGAATTTCCTCCACAACATAACTCATTAAACAATATATATAATAAAAAACAATC  8760
        R  K  V  *  L  L  H  Q  I  S  Y  N  T  I  Y  I  I  K  Q  *
       G  K  *  K  F  S  T  N  Y  Q  T  I  Q  *  I  Y  *  K  K  N
         K  E  S  L  P  P  T  T  N  L  L  K  N  Y  I  N  N  K  T  L

8761  AAATTAGACAAAATATAATAACACCCGAAATAACGGATGTATATCACAAATATTCAGACT  8820
        N  L  R  N  *  I  I  T  P  K  I  A  *  M  Y  H  K  Y  T  Q
       T  *  D  T  K  Y  *  Q  P  S  *  Q  R  C  I  T  N  I  L  R
         K  I  Q  K  I  N  N  H  A  K  N  G  V  Y  L  T  *  L  D  S

8821  ATAAGTAAACGGACGAATACGATCAAAATTTCAATAACTATTACCACAACAATCTCTATA  8880
        Y  E  N  A  Q  K  H  *  N  *  L  *  Q  Y  H  H  Q  *  L  Y
       I  N  M  Q  R  S  I  S  T  K  F  N  N  I  I  T  N  N  S  I
         I  *  K  G  A  *  A  L  K  L  T  I  S  L  P  T  T  L  S  I

8881  AAGTCAATTACTAAATACAAAACGATTATTTAAAAAGGTTAAACTAGTTACCATACTCAG  8940
        K  L  *  H  N  I  N  Q  *  Y  I  K  G  I  Q  D  I  T  H  T
       N  *  N  I  I  *  T  K  S  I  F  K  E  L  K  I  L  P  I  L
         E  T  L  S  K  H  K  A  L  L  N  K  W  N  S  *  H  Y  S  D

8941  GTGAAAACCCAGACAAATGATAGTATTAAGATACCTAACGGGATAACATCACCGTCAATA  9000
        W  K  Q  T  Q  K  S  D  Y  N  *  P  N  G  *  Q  L  P  L  *
       G  S  K  P  R  N  V  I  M  I  R  H  I  A  R  N  Y  H  C  N
         V  K  P  D  T  *  *  *  L  E  I  S  Q  G  I  T  T  A  T  I

9001  CCTACTTCTATAGCCAAGATGATACAAATTACAAGGATGATTTCAAAACTCTGTACCGAA  9060
        P  H  L  Y  R  N  *  *  T  *  H  E  *  *  L  K  S  V  H  S
       H  I  F  I  D  T  R  S  H  K  I  N  R  S  F  N  Q  S  M  A
         S  S  S  I  P  E  V  I  N  L  T  G  V  L  T  K  L  C  P  K

9061  AGTACAAAATGTAAAAAATTGAATACGTAAACGATCACTATCACAAGTCACGATATGTGG  9120
        E  H  K  V  N  K  L  K  H  M  Q  *  H  Y  H  E  T  S  Y  V
       K  M  N  *  M  K  *  S  I  C  K  S  T  I  T  N  L  A  I  C
         *  T  K  C  K  K  V  *  A  N  A  L  S  L  T  *  H  *  V  G

9121  TGTATAAGTCTAAAGAATATTACTAAAAATACGATCACCAACACAAAATAGTAGAAACAC  9180
        V  Y  E  S  K  K  Y  H  N  K  H  *  H  N  H  K  I  M  K  T
       W  M  N  L  N  R  I  I  I  K  I  S  T  T  T  N  *  *  R  Q
         C  I  *  I  E  *  L  S  K  *  A  L  P  Q  T  K  D  D  K  H
```

FIG. 3 CONT'D

```
9181  ATGATACAAATTTTCTCCACTACCATGTGGTGTAGGAATAACAATAAGTCTACCACAATA  9240
       Y * T * F L H H Y V V D K N N N L H H *
       T S H K F S T I T C W M R I T I * I T N
         V I N L L P S P V G C G * Q * E S P T I

9241  CTTCTTACGAAGAAACATATGTAGAAACCAAGGTGTATGTGCAATATCGGAACGATTAAG  9300
       S S H K K T Y M K P E V Y V N Y G Q * N
       H L I S R Q I C R Q N W M C T I A K S I
         F F A E K Y V D K T G C V R * L R A L E

9301  ATTACCAAAATATTCTAAAGGACTACAATAATCACTTCCATAACATGCATAACATTCTTG  9360
       * H N * L I E Q H * * H L Y Q V Y Q L F
       R I T K Y S K R I N N T F T N Y T N Y S
         L P K I L N G S T I L S P I T R I T L V

9361  CGCGAGATACTGAATAACATCTCACCCACGTACACTTATGCGGCTTCTCCCATATACAAA  9420
       A S * S K N Y L P H M H I R R L P Y I N
       R A R H S I T S H T C T F V G F L T Y T
         R E I V * Q L T P A H S Y A S S P I H K

9421  ATTAAAATTATCAAGGACCCAAAACTTATTACTAATAATATCTTCATACGGACCTTGAAA  9480
       * N * Y N R P K S Y H N N Y F Y A Q F K
       K I K I T G P N Q I I I I S T H R S S
         L K L L E Q T K F L S * * L L I G P V K

9481  AACACCATCTCTAGAAAAACTAAACAAAATAGTTAAAAAATCATCAAATTAAGCAGGATA  9540
       K H Y L D K Q N T K D I K * Y N L E D *
       K T T S I K K I Q K I L K K T T * N T R
         Q P L S R K S K N * * N K L L K I R G I

9541  TCTAAAGAAAAGAGAATGACGATCAAGATAAAAACCTCGATATAACCGATATCAACAACA  9600
       L N R K E * Q * N * K Q L * I P * L Q Q
       Y I E K R K S S T R N K S S Y Q S Y N N
         S K K E R V A L E I K P A I N A I T T T

9601  GAACCAAAAAATAATAAATTATTTTGAATTCGCACGAAAACCTCTAATATGATCACAACA  9660
       R P K K N N L L V * A H K Q L N Y * H Q
       D Q N K I I * Y F K L T S K S I I S T N
         K T K * * K I F S L R A K P S * V L T T

9661  TCAATATTTACAACAACAAACCACATAATTAAAAGAATACGAAAAACAAAAAGTTCAAAT  9720
       L * L H Q Q K T Y * N E * A K Q K E L K
       Y N Y I N N P T N I K K H K K N K L N
         T I F T T T Q H I L K R I S K T K * T *
```

FIG. 3 CONT'D

```
9721  AGGATAAACACGTACACAAATACGAACAAAAATAAAAATACATTGTAACATAAAAGGAAG  9780
         D  *  K  H  M  H  K  H  K  N  K  N  K  H  L  M  T  N  E  K
        I  R  N  T  C  T  N  I  S  T  K  I  K  I  Y  C  Q  I  K  R
          G  I  Q  A  H  T  *  A  Q  K  *  K  *  T  V  N  Y  K  G  E

9781  ACTTTAATCACATTAATACGTAAACGTTACCTAACAATACATACCACGATATTACGGAAA  9840
         Q  F  *  H  L  *  A  N  A  I  S  Q  *  T  H  H  *  L  A  K
        R  F  N  T  Y  N  H  M  Q  L  P  N  N  H  I  T  S  Y  H  R
          S  I  L  T  I  I  C  K  C  H  I  T  I  Y  P  A  I  I  G  K

9841  AACCAAAACACAGTGTATACATCGATACCAATAACGTTTGGTACAAAATACCAATAAAAG  9900
         K  T  K  H  *  M  H  L  *  P  *  Q  L  G  H  K  I  T  I  K
        K  P  K  T  D  C  I  Y  S  H  N  N  C  V  M  N  *  P  *  K
          Q  N  Q  T  V  Y  T  A  I  T  I  A  F  W  T  K  H  N  N  E

9901  TATAACATCCTTTTAACCACAATTACATACATCACTATCATGTAAACTTCTTTGTAGAGA  9960
         M  N  Y  S  F  Q  H  *  H  I  Y  H  Y  Y  M  Q  L  F  M  E
        *  I  T  P  F  N  T  N  I  Y  T  T  I  T  C  K  F  F  C  R
          Y  Q  L  F  I  P  T  L  T  H  L  S  L  V  N  S  S  V  D  R

9961  ATGATGAAAATACTAATGATTTCTAAGAATAACATCTAATTTCTTAAGACAAAGACTACA  10020
         *  *  K  *  S  *  *  L  N  K  N  Y  I  L  S  N  Q  K  Q  H
        K  S  S  K  H  N  S  F  I  R  I  T  S  *  L  I  R  N  R  I
          V  V  K  I  I  V  L  S  E  *  Q  L  N  F  F  E  T  E  S  T

10021 ACGGATGTTATCTATAAACTCAAACATATTATTCATAGCAATGATATCACCATTTTACCT  10080
         Q  R  C  Y  I  N  S  N  T  Y  Y  T  D  N  S  Y  H  Y  F  P
        N  G  V  I  S  I  Q  T  Q  I  I  L  I  T  V  I  T  T  F  H
          A  *  L  L  Y  K  L  K  Y  L  L  Y  R  *  *  L  P  L  I  S

10081 ATGACGACGGATATCTCTTCGCCGCACAAGAGTCAATCGATTTCGATACCTTTGTAAATT  10140
         Y  Q  Q  R  Y  L  L  P  T  N  E  T  L  *  L  *  P  F  M  *
        I  S  S  G  I  S  F  R  R  T  R  L  *  S  F  S  H  F  C  K
          V  A  A  *  L  S  A  A  H  E  *  N  A  L  A  I  S  V  N  L

10141 AGTGTTATTACCATTACTACAGAATATGGTTGGAGGATGTCGTAGACAAAGATGTAGAAA  10200
         D  C  Y  H  Y  H  H  R  I  G  V  E  *  L  M  Q  K  *  M  K
        I  V  I  I  T  I  I  D  *  V  L  R  R  C  C  R  N  R  C  R
          *  L  L  P  L  S  T  K  Y  W  G  G  V  A  D  T  E  V  D  K

10201 AAACGTTAGTCCATAACATTTCTACCATAGAGGATGCAGTTTTTAACTTGGAACATAACA  10260
         K  A  I  L  Y  Q  L  S  P  I  E  *  T  L  F  Q  V  K  Y  Q
        K  Q  L  *  T  N  Y  L  H  Y  R  R  R  *  F  N  F  R  T  N
          K  C  D  P  I  T  F  I  T  D  G  V  D  F  I  S  G  Q  I  T
```

FIG. 3 CONT'D

```
10261 ATCACAATGAATACCATCATACTGAAACTTACCAAATACCAATCTACTGTTTCAAATAAC 10320
      *  H  *  K  H  Y  Y  S  K  S  H  N  I  T  L  H  C  L  K  N
       N  T  N  S  I  T  T  H  S  Q  I  T  *  P  *  I  V  F  N  I
        L  T  V  *  P  L  I  V  K  F  P  K  H  N  S  S  L  T  *  Q

10321 AGGAGCAGTACAATATACAAGTAGGAGATTATACTTGCTTGGACTAATAAGACGGAATAA 10380
       D  E  D  H  *  I  N  M  R  *  Y  S  R  V  Q  N  N  Q  R  I
        T  R  T  M  N  Y  T  *  G  R  I  H  V  F  R  I  I  R  G  *
         G  R  *  T  I  H  E  D  E  L  I  F  S  G  S  *  E  A  K  N

10381 CACATCTCAATGAGATCCACTAAAATGATATTACAGACCAGCCTACTCAAATTGTCAACA 10440
       T  Y  L  *  E  L  H  N  *  *  L  T  Q  D  S  S  N  L  L  Q
        Q  T  S  N  S  *  T  I  K  S  Y  H  R  T  P  H  T  *  C  N
         H  L  T  V  R  P  S  K  V  I  I  D  P  R  I  L  K  V  T  T

10441 CAGAATGGTCTACGTCCCGACAGTTGAACAAAACTGTCAGAGAAATGTTTTAGGAATGTG 10500
       T  K  G  S  A  P  S  D  V  Q  K  S  L  R  K  V  F  D  K  C
        H  R  V  L  H  L  A  T  L  K  N  Q  C  D  R  *  L  I  R  V
         D  *  W  I  C  P  Q  *  S  T  K  V  T  E  K  C  F  G  *  V

10501 AGGTTTTATATGAAAACCATTACAATTTGGACCACTTTGAAAATGACAAAATCGACGCAT 10560
       E  L  I  Y  K  Q  Y  H  *  V  Q  H  F  K  *  Q  K  L  Q  T
        S  W  F  I  S  K  T  I  N  F  R  T  F  S  K  S  N  *  S  R
         G  F  Y  V  K  P  L  T  L  G  P  S  V  K  V  T  K  A  A  Y

10561 ATTACCGGCTGGTGTTCCCCGTAAAGTACAATGATACGCATCATCAATATGATAATTTCC 10620
       Y  H  G  V  V  L  P  M  E  H  *  *  A  Y  Y  N  Y  *  *  L
        I  I  A  S  W  L  P  C  K  M  N  S  H  T  T  T  I  S  N  F
         L  P  R  G  C  P  A  N  *  T  V  I  R  L  L  *  V  I  L  P

10621 AAGAAAAAACACACCCAGTACACCTAGACAACCAATACATAATTGTCCACTATCACAATT 10680
       N  K  K  T  H  T  M  H  I  Q  Q  N  H  I  L  L  H  Y  H  *
        T  R  K  Q  T  P  *  T  S  R  N  T  I  Y  *  C  T  I  T  N
         E  K  K  H  P  D  H  P  D  T  P  *  T  N  V  P  S  L  T  L

10681 CAAACATATATACGTAGTTAATCTCGAGTCATGACCAACAGTGTGACCGTGACTAAAATG 10740
       T  Q  I  Y  A  D  I  L  A  *  Y  Q  N  D  C  Q  C  Q  N  *
        L  K  Y  I  H  M  L  *  L  E  T  S  T  T  V  S  A  S  I  K
         N  T  Y  I  C  *  N  S  S  L  V  P  Q  *  V  P  V  S  K  V

10741 ACCATTAAAAATACCAGGTATATCTCTACGAGTTCAACATGTCAACGGTCAATTCCTGAT 10800
       Q  Y  N  K  H  D  M  Y  L  H  E  L  Q  V  T  A  L  *  P  S
        S  T  I  K  I  T  W  I  S  I  S  L  N  Y  L  Q  W  N  L  V
         P  L  K  *  P  G  Y  L  S  A  *  T  T  C  N  G  T  L  S  *
```

FIG. 3 CONT'D

```
10801  GCAGGTCTGACAATTACAATAACGAACCGAGATACGTCGATATGAATTATTAACACGAAC  10860
          R  G  S  Q  *  H  *  Q  K  A  R  H  L  *  V  *  Y  N  H  K
         V  D  L  S  N  I  N  N  S  P  E  I  C  S  Y  K  I  I  T  S
            T  W  V  T  L  T  I  A  Q  S  *  A  A  I  S  L  L  Q  A  Q

10861  CAAACATGTTTTACTACAAACAAGATGACTTCTAAAATTACAAACCCGATACCGTTTACC  10920
          T  Q  V  F  H  H  K  N  *  Q  L  N  *  H  K  P  *  P  L  H
         P  K  Y  L  I  I  N  T  R  S  F  I  K  I  N  P  S  H  C  I
            N  T  C  F  S  T  Q  E  V  S  S  K  L  T  Q  A  I  A  F  P

10921  AAAATCGGTTCATTTTCGTCTAGAACAGAATCTACGAAACCGAAGTTACTGTCCACAAAG  10980
          N  *  G  L  L  L  L  D  Q  R  L  H  K  P  K  L  S  L  H  K
         T  K  A  L  Y  F  C  I  K  D  *  I  S  Q  S  *  H  C  T  N
            K  L  W  T  F  A  S  R  T  K  S  A  K  A  E  I  V  P  T  E

10981  ATAACTTTGAAATAACCGACGATAATTCGCAGATATATACCCTAAAGTTCCAGCAGTTTA  11040
          *  Q  F  K  I  P  Q  *  *  A  D  I  Y  P  I  E  L  D  D  F
         R  N  F  S  *  Q  S  S  N  L  T  *  I  H  S  K  L  T  T  L
            I  S  V  K  N  A  A  I  L  R  R  Y  I  P  N  *  P  R  *  I

11041  TGATCCTTCAACATGAAAACTTCTACTTAACCGTGGAAGACTGCAAATAGTTGTTAACCG  11100
          V  L  F  N  Y  K  Q  L  H  I  P  V  K  Q  R  K  D  V  I  P
         Y  *  S  T  T  S  K  F  I  F  Q  C  R  R  V  N  I  L  L  Q
            S  P  L  Q  V  K  S  S  S  N  A  G  E  S  T  *  *  C  N  A

11101  ACCACAATTTAACGTTAGATTTTGTTTTTCTAAATAATTTCTTTGTTAAATAACCTAAAA  11160
          Q  H  *  I  A  I  *  F  L  F  I  *  *  L  F  L  K  N  S  K
         S  T  N  F  Q  L  R  F  C  F  S  K  N  F  F  C  N  I  P  N
            P  T  L  N  C  D  L  V  F  L  N  I  L  S  V  I  *  Q  I  K

11161  CTATAGATGTAAAAACAAATCAACATATTAAAGACGTAAACAATTTACCTGATATAAATA  11220
          S  I  *  M  K  T  *  N  Y  L  K  Q  M  Q  *  I  S  *  I  *
         Q  Y  R  C  K  Q  K  T  T  Y  N  R  C  K  N  F  P  S  Y  K
            I  D  V  N  K  N  L  Q  I  I  E  A  N  T  L  H  V  I  N  I

11221  CATATAATTATGTGTATACTAACCACAATGTAATACACATGAAACAAAACAATCAAAATA  11280
          T  Y  *  Y  V  Y  S  Q  H  *  M  I  H  V  K  N  Q  *  N  *
         H  I  N  I  C  M  H  N  T  N  C  *  T  Y  K  T  K  N  T  K
            Y  I  L  V  C  I  I  P  T  V  N  H  T  S  Q  K  T  L  K  I

11281  CTACAATGATCAATTTGTATTCGTAAAAATAAACTGATACATATATTAAGGACATGAGAC  11340
          S  T  V  L  *  V  Y  A  N  K  N  S  *  T  Y  L  E  Q  V  R
         H  H  *  *  N  F  M  L  M  K  I  Q  S  H  I  Y  N  R  Y  E
            I  N  S  T  L  C  L  C  K  *  K  V  I  Y  I  I  G  T  S  Q
```

FIG. 3 CONT'D

```
11341  ATGGAACAAAATACATTTAATAAATCAACAAATATTCCTTCCAAAATCTCCAAAATGAAT  11400
        Y  R  T  K  H  L  N  N  L  Q  K  Y  P  L  N  *  L  N  *  K
         T  G  Q  K  I  Y  I  I  *  N  N  I  L  F  T  K  S  T  K  S
          V  K  N  *  T  F  *  K  T  T  *  L  S  P  K  L  P  K  V  *

11401  ACAGACCGAGAGTATAAAACAAGGACGACACTTAAAATGAATACAAATACTTCATAAAAT  11460
        H  R  A  R  M  N  Q  E  Q  Q  S  N  *  K  H  K  H  L  I  K
         I  D  P  E  *  I  K  N  R  S  H  I  K  S  I  N  I  F  Y  K
          T  Q  S  E  Y  K  T  G  A  T  F  K  V  *  T  *  S  T  N  *

11461  ACCAACATAAAATACACAAAAACGATAAAAATATTGATACGTATCATAATTAGTACTGTA  11520
        H  N  Y  K  I  H  K  Q  *  K  *  L  *  A  Y  Y  *  D  H  C
         I  T  T  N  *  T  N  K  S  N  K  Y  S  H  M  T  N  I  M  V
          P  Q  I  K  H  T  K  A  I  K  I  V  I  C  L  I  L  *  S  M

11521  AAAAAGAAACTACAAAAACCAACCATCTTATCAATGAAATTAAAGATACACCATAAAACC  11580
        K  K  K  S  T  K  P  Q  Y  F  L  *  K  L  K  *  T  T  N  Q
         N  K  R  Q  H  K  Q  N  T  S  Y  N  S  *  N  R  H  P  I  K
          K  E  K  I  N  K  T  P  L  I  T  V  K  I  E  I  H  Y  K  P

11581  CAGCTTAAATCTTCTCCTACAAAACAATAAATAATGTCGGAAAAATCCATGAATATGTAC  11640
        T  S  N  L  L  P  H  K  T  I  *  *  L  R  K  L  Y  K  Y  M
         P  R  I  *  F  L  I  N  Q  *  K  N  C  G  K  *  T  S  I  C
          D  F  K  S  S  S  T  K  N  N  I  V  A  K  K  P  V  *  V  H

11641  CTGGTGATAAAACAGTAATCGATATCGTTTTTAACAACGATTAACCAACAGACAATTATA  11700
        S  W  *  K  T  M  L  *  L  L  F  Q  Q  *  N  T  T  Q  *  Y
         P  G  S  N  Q  *  *  S  Y  C  F  N  N  S  I  P  Q  R  N  I
          V  V  I  K  D  N  A  I  A  F  I  T  A  L  Q  N  D  T  L  I

11701  TAAAATAAAATGTCTACATGGAATATAATTTAACTAAGAGAACTCAATGAATAAATATCC  11760
        I  K  N  *  L  H  V  K  Y  *  I  S  E  R  S  N  S  I  *  L
         Y  K  I  K  C  I  Y  R  I  N  F  Q  N  E  Q  T  V  *  K  Y
          N  *  K  V  S  T  G  *  I  L  N  I  R  K  L  *  K  N  I  P

11761  CATATAAAATAGAACAATAACCCCTAAAAAGAGAGAAAATTTGTCACAAAAATCTTACGG  11820
        T  Y  K  I  K  N  N  P  I  K  R  E  K  L  C  H  K  *  F  A
         P  I  N  *  R  T  I  P  S  K  E  R  K  *  V  T  N  K  S  H
          Y  I  K  D  Q  *  Q  P  N  K  E  R  K  F  L  T  K  L  I  G

11821  ATACCCACAAATATTAATATTTTAAAGACAAGTTCTTAACGCAATATACTTACGATTACC  11880
        *  P  H  K  Y  N  Y  F  K  Q  E  L  I  A  N  Y  S  H  *  H
         R  H  T  N  I  I  I  F  N  R  N  L  F  Q  T  I  H  I  S  I
          I  P  T  *  L  *  L  I  E  T  *  S  N  R  *  I  F  A  L  P
```

FIG. 3 CONT'D

```
11881  GAATGCAGGTGGAGCATTATCAAAACTCCGATAAAACAATTTAAATTTTGACGAACCTTA  11940
         S  V  D  V  E  Y  Y  N  Q  P  *  K  T  L  N  L  V  A  Q  F
        A  *  T  W  R  T  I  T  K  L  S  N  Q  *  I  *  F  Q  K  S
          K  R  G  G  R  L  L  K  S  A  I  K  N  F  K  F  S  S  P  I

11941  TCCACCGCACGGTCAATAACTTCAGAGGGTTTAAGTTAGTTTTAACTGACTACACTTTAC  12000
         L  H  R  A  L  *  Q  L  R  G  F  E  I  L  I  S  Q  H  S  I
        Y  T  A  H  W  N  N  F  D  G  L  N  L  *  F  Q  S  I  H  F
          P  P  T  G  T  I  S  T  E  W  I  *  D  F  N  V  S  T  F  H

12001  ACGATTACAACAAAACAATTTAACAAATGTCGTAAACGTACAACGAAGATTAAGATTCAA  12060
         H  *  H  Q  K  T  L  N  N  V  A  N  A  H  Q  K  *  N  *  T
        T  S  I  N  N  Q  *  I  T  *  L  M  Q  M  N  S  R  I  R  L
          A  L  T  T  K  N  F  Q  K  C  C  K  C  T  A  E  L  E  L  N

12061  CACCGTCATAACATCACAAAATGTATTACTTTATGATAGATGAAGTCTAAACTCACATCG  12120
         T  A  T  N  Y  H  K  V  V  Y  H  F  V  I  *  K  L  N  S  H  L
        Q  P  L  I  T  T  N  *  M  I  F  Y  *  R  S  *  I  Q  T  Y
          H  C  Y  Q  L  T  K  C  L  S  I  S  D  V  E  S  K  L  T  A

12121  AAAACTATTCGAACGAGTTAATAACTAACAAAATAAGCGGTTAGGACGACGTCAACTATG  12180
         K  Q  Y  A  Q  E  I  I  S  Q  K  I  R  W  D  Q  Q  L  Q  Y
        S  K  I  L  K  S  L  *  Q  N  N  *  E  G  I  R  S  C  N  I
          K  S  L  S  A  *  N  N  I  T  K  N  A  L  G  A  A  T  S  V

12181  ATTCACAGAACGTTCATATCTACTTCAATCGCTACTAATACAAGTTCTATCATGGCAAAA  12240
         *  T  D  Q  L  Y  L  H  L  *  R  H  N  H  E  L  Y  Y  R  K
        S  L  T  K  C  T  Y  I  F  N  A  I  I  I  N  L  I  T  G  N
          L  H  R  A  L  I  S  S  T  L  S  S  *  T  *  S  L  V  T  K

12241  CGTCCGAAACGTTTCACTCAAACATTTATACCGATCAAAACAACTTATACTTCAGCGTTT  12300
         A  P  K  A  F  H  T  Q  L  Y  P  *  N  Q  Q  I  H  L  R  L
        Q  L  S  Q  L  T  L  K  Y  I  H  S  T  K  N  F  I  F  D  C
          C  A  K  C  L  S  N  T  F  I  A  L  K  T  S  Y  S  T  A  F

12301  CTTTTTAAACCGACTACGATTTTTATCACCAAGACAATTAGTTGTTGTCTATTTTGTCAA  12360
         S  F  N  P  Q  H  *  F  Y  H  Q  *  D  V  V  S  L  V  T
        L  F  I  Q  S  I  S  F  I  T  T  R  N  I  L  L  L  Y  F  L
          F  F  K  A  S  A  L  F  L  P  E  T  L  *  C  C  I  F  C  N

12361  TCTTTTTCGTACATTATATCGATTCAGACACATACTTGCACTATTTCGACATCGAGCGTT  12420
         L  F  L  M  Y  Y  L  *  T  Q  T  H  V  H  Y  L  Q  L  E  C
        *  F  F  C  T  I  Y  S  L  R  H  I  F  T  I  F  S  Y  S  A
          S  F  A  H  L  I  A  L  D  T  Y  S  R  S  L  A  T  A  R  L
```

FIG. 3 CONT'D

```
12421  TGAACTTGCATACCGTCTGGATCGTGAATGATTGTACATATTTCTCCGAGCCTAATTACT  12480
         V Q V Y P L G L V * * C T Y L P E S * H
        F K F T H C V * C K S V H I F L S P N I
         S S R I A S R A S V L M Y L S A R I L S

12481  ATTCTTCTCATTTCAACAAAGGCGAAACGTCTGTTACGAAAAATCGTACCAAGCATTTAA  12540
         Y S S Y L Q K R K A S L A K * C P E Y I
        I L L T F N N G S Q L C H K K A H N T F
         L F L L T T E A K C V I S K L M T R L N

12541  CCTATTAGTCCGAAATTTAAGATAAGACCTATTACGACAATTTCCAACACATGGAAACTC  12600
         P Y D P K L N * E P Y H Q * L N H V K S
        Q I I L S * I R N Q I I S N F T T Y R Q
         S L * A K F E I R S L A T L P Q T G K L

12601  ACGATAAGGTCGTAACCGACGATTATGAAATTGATATCATTATGGTCTATTTGTTCAAAA  12660
         H * E L M P Q * Y K L * L L V L Y V L K
        T S N W C Q S S I S * S Y Y Y W I F L N
         A I G A N A A L V K V I T I G S L C T K

12661  ACTATTTCAACAACTATTACAAATACAATGTATACGACCATCACATACCGTATATGTCTG  12720
         Q Y L Q Q Y H K H * M H Q Y H I A Y V S
        K I F N N I I N I N C I S T T Y P M Y L
         S L T T S L T * T V Y A P L T H C I C V

12721  ACAAGTTCTACGACTACCATAATTATTTGTCAATTGACTATAATCACAACTAAGATTAAC  12780
         Q E L H Q H Y * Y V T L Q Y * H Q N * N
        S N L I S I T N I F L * S I N T N I R I
         T * S A S P I L L C N V S I L T S E L Q

12781  CGGAGAACAATAGTAACGCTTGTCCATATTACTTCAACGATTACGACAATACGTCTTATT  12840
         A E Q * * Q S C T Y H L Q * H Q * A S Y
        P R K N D N R V P I I F N S I S N H L I
         G R T I M A F L Y L S T A L A T I C F L

12841  ACTCAACTACGGAGTATTTAATTTTTATGTTCAACAATTATCACCAAGACTATACTTAAC  12900
         H T S A E Y I L F V L Q * Y H N Q Y S N
        I L Q H R M F * F Y L N N I T T R I H I
         S N I G * L N F I C T T L L P E S I F Q

12901  ATTATAAGGATGAGTTACAATAATATTATTACCATCATCACCATCTTATCAAATACGACA  12960
         Y Y E * E I N N Y Y H Y Y H Y F L K H Q
        T I N R S L T I I I I T T T T S Y N I S
         L I G V * H * * L L P L L P L I T * A T
```

FIG. 3 CONT'D

```
12961  AGAATCACTACAACTACCAGAATTCATATGATTCTATTACTTTCTACTACCTTTAACACA  13020
         E  *  H  H  Q  H  D  *  T  Y  *  S  L  S  L  H  H  F  N  H
          N  K  T  I  N  I  T  K  L  I  S  L  Y  H  F  I  I  S  I  T
            R  L  S  T  S  P  R  L  Y  V  L  I  I  F  S  S  P  F  Q  T

13021  ACAAAATCTCGAACTAGGAGGAACATTTAAAAGATATGTTCTACAATTCCCTGAATTTTA  13080
         Q  K  L  A  Q  D  E  K  Y  I  K  *  V  L  H  *  P  V  *  F
          N  N  *  L  K  I  R  R  T  F  K  R  Y  L  I  N  L  S  K  F
            T  K  S  S  S  G  G  Q  L  N  E  I  C  S  T  L  P  S  L  I

13081  ATTCATAGAAATAAAATAATTTCCTACATTGTGAAATCGATCTCCCACCCAACAACCATG  13140
         *  T  D  K  N  *  *  L  I  Y  C  K  L  *  L  T  P  Q  Q  Y
          N  L  I  K  I  K  N  F  S  T  V  S  *  S  S  P  P  N  N  T
            L  Y  R  *  K  I  L  P  H  L  V  K  A  L  P  H  T  T  P  V

13141  AAATAGAAGTTGTTAATCTAACGTCCGACCACAACGATGACTCATACGTCGATTAAGAAG  13200
         K  I  K  L  L  *  I  A  P  Q  H  Q  *  Q  T  H  L  *  N  K
          S  *  R  *  C  N  S  Q  L  S  T  N  S  S  L  I  C  S  I  R
            K  D  E  V  I  L  N  C  A  P  T  A  V  S  Y  A  A  L  E  E

13201  ATATGAAAGTAATACACGTAAAAGACATCTAGGATTCTTTTGAATAAATCTAATATATGT  13260
         *  V  K  M  I  H  M  K  Q  L  D  *  S  F  K  N  L  N  Y  V
          R  Y  K  *  *  T  C  K  R  Y  I  R  L  F  S  I  *  I  I  Y
            I  S  E  N  H  A  N  E  T  S  G  L  F  V  *  K  S  *  I  C

13261  TGTTCCACCACATGGATATTAATTAACACAATTTTACGAGACACTAGTACGACCATGACC  13320
         V  L  H  H  V  *  L  *  N  H  *  F  A  R  H  D  H  Q  Y  Q
          L  L  T  T  Y  R  Y  N  I  T  N  F  H  E  T  I  M  S  T  S
            C  P  P  T  G  I  I  L  Q  T  L  I  S  Q  S  *  A  P  V  P

13321  ATACCGGTAATGATAATTTGGACTCCGATGATAATTGGTTCTAAGAATACCACCACGGAG  13380
         Y  P  W  *  *  *  V  Q  P  *  *  *  G  L  N  K  H  H  H  R
          T  H  G  N  S  N  F  R  L  S  S  N  V  L  I  R  I  T  T  G
            I  A  M  V  I  L  G  S  A  V  I  L  W  S  E  *  P  P  A  E

13381  TCAAACATAAATAACGGCACGTGCACATCTCGTAGGTCTACATCTACCATATACATTTAA  13440
         L  K  Y  K  N  G  H  V  H  L  A  D  L  H  L  H  Y  I  Y  I
          *  N  T  N  I  A  T  C  T  Y  L  M  W  I  Y  I  T  Y  T  F
            T  Q  I  *  Q  R  A  R  T  S  C  G  S  T  S  P  I  H  L  N

13441  TGCACCATTTAAACATGTTCAGGGAAACCCATATTTTCTAGGATAAGAAATACACAATTG  13500
         V  H  Y  I  Q  V  L  G  K  P  Y  L  L  D  *  E  K  H  T  L
          *  T  T  F  K  Y  L  D  R  Q  T  Y  F  I  R  N  K  I  H  *
            R  P  L  N  T  C  T  G  K  P  I  F  S  G  I  R  *  T  N  V
```

FIG. 3 CONT'D

```
13501  TGTACTACAAACAGTTCAGACACCAAAAACCTCTCTACCGTCAACAAGGACACATCCAAG  13560
          V  H  H  K  D  L  R  H  N  K  S  L  H  C  N  N  R  H  L  N
           C  M  I  N  T  L  D  T  T  K  P  S  I  A  T  T  G  T  Y  T
             C  S  T  Q  *  T  Q  P  K  Q  L  S  P  L  Q  E  Q  T  P  E

13561  TTCACAGCGACAAGTTAGATTTCTAAATTTAAAAAATTTGCCCAAGCCCCATGATCACAC  13620
          L  H  R  Q  E  I  *  L  N  L  N  K  L  R  T  R  P  V  L  T
           *  T  D  S  N  L  R  F  I  *  I  K  *  V  P  E  P  Y  *  H
             L  T  A  T  *  D  L  S  K  F  K  K  F  P  N  P  T  S  T  H

13621  TTACGGGCCGATCATGGGACACGATCACCAAATAGATGACTACAAGTTAATTCCCGTAAA  13680
          F  A  R  S  T  G  Q  A  L  P  K  D  V  S  T  *  N  L  A  N
           S  H  G  A  L  V  R  H  *  H  N  I  *  Q  H  E  I  L  P  M
             I  G  P  *  Y  G  T  S  T  T  *  R  S  I  N  L  *  P  C  K

13681  CTGTAAACATTATGGTTATCTCGACCATATCCAAATATAATATTTCACTTAACAACGGCA  13740
          S  M  Q  L  V  L  L  A  P  I  P  K  Y  *  L  T  F  Q  Q  R
           Q  C  K  Y  Y  W  Y  L  Q  Y  L  N  I  N  Y  L  S  N  N  G
             V  N  T  I  G  I  S  S  T  Y  T  *  I  I  F  H  I  T  A  T

13741  AAAGTCGCATATCTACTGCTGCCATTATTTAACCTATTCAAGAAACAACAGTTTTCTTGA  13800
          K  *  R  I  S  S  S  P  L  L  N  S  L  N  K  T  T  L  L  V
           N  E  A  Y  L  H  R  R  Y  Y  I  P  Y  T  R  Q  Q  *  F  F
             K  L  T  Y  I  V  V  T  I  F  Q  I  L  E  K  N  D  F  S  S

13801  TTAAATCTTCAAATATTATTTCTCTTTTGAATAATACTCAACTGATTTTCAACACCACAA  13860
          L  K  S  T  *  L  L  S  F  V  *  *  S  N  V  L  L  Q  P  T
           *  N  L  L  K  Y  Y  L  S  F  K  N  H  T  S  *  F  N  H  H
             I  *  F  N  I  I  F  L  F  S  I  I  L  Q  S  F  T  T  T  N

13861  CACCGACTTGTACTAAAGAAATGTAAACTATAACTACCATCAGCGCACGGTGTATATCAA  13920
          T  A  S  C  S  K  K  V  N  S  I  S  P  L  R  T  G  C  I  T
           Q  P  Q  V  H  N  R  *  M  Q  Y  Q  H  Y  D  R  A  V  Y  L
             H  S  F  M  I  E  K  C  K  I  N  I  T  T  A  H  W  M  Y  N

13921  GCATCCTTAGAAAGTTTCATATGATACAATCTAGAAACGATACGTAACGCAGTAAAACTA  13980
          R  L  F  R  E  F  Y  V  I  N  S  R  Q  *  A  N  R  *  K  S
           E  Y  S  D  K  L  T  Y  *  T  L  D  K  S  H  M  A  D  N  Q
             T  P  I  K  *  L  I  S  H  *  I  K  A  I  C  Q  T  M  K  I

13981  GCATTACTAACAAGTTATAACACACTTTAAGAAACACTCATACGACTAACATTTCTTAGG  14040
          R  L  S  Q  E  I  N  H  S  I  R  Q  S  Y  A  S  Q  L  S  D
           D  Y  H  N  N  L  I  T  H  F  E  K  H  T  H  Q  N  Y  L  I
             T  I  I  T  *  Y  Q  T  F  N  K  T  L  I  S  I  T  F  F  G
```

FIG. 3 CONT'D

```
14041  ATGAAAAGATTCTTTCTAACCATACTAAAACAACTTTTAGGACTATAATAATTATATATA  14100
         *  K  E  L  F  S  Q  Y  S  K  T  S  F  G  S  I  I  L  I  Y
          R  S  K  *  S  L  N  T  H  N  Q  Q  F  D  Q  Y  *  *  Y  I
           V  K  R  L  F  I  P  I  I  K  N  F  I  R  I  N  N  I  Y  I

14101  TTTTTTAATCCGGGATAAAAATTATCTCGAAATGAATTATGACAGTAAAAACGTCTGTGG  14160
         L  F  N  P  G  I  K  L  L  A  K  S  L  V  T  M  K  A  S  V
          Y  F  I  L  G  *  K  *  Y  L  K  V  *  Y  Q  *  K  Q  L  C
           F  F  *  A  R  N  K  I  S  S  *  K  I  S  D  N  K  C  V  G

14161  AATCAACTTCATCCAAATCAACCACAAAATTGAAATCTATTGGTTCTAAACATACCAGTT  14220
         K  T  S  T  P  K  T  P  T  K  V  K  S  L  W  S  K  Y  P  *
          R  L  Q  L  L  N  L  Q  H  K  L  K  L  Y  G  L  N  T  H  D
           *  N  F  Y  T  *  N  T  N  *  S  *  I  V  L  I  Q  I  T  L

14221  ACCATACTAAAACCACTAAAATATGTTTGTCGGGGTCCCAAACCACACCGTCAACGTCTA  14280
         H  Y  S  K  P  S  K  I  C  V  A  G  P  N  P  T  A  T  A  S
          I  T  H  N  Q  H  N  *  V  F  L  G  L  T  Q  H  P  L  Q  L
           P  I  I  K  T  I  K  Y  L  C  G  W  P  K  T  H  C  N  C  I

14281  AGAATGATAAGAATATACTACGGATACAACTGATACACAGTACATAATCTAACACTTAAT  14340
         E  *  *  E  *  I  I  G  I  N  V  I  H  *  T  N  S  Q  S  N
          N  K  S  N  K  Y  S  A  *  T  S  *  T  D  H  I  L  N  H  I
           R  V  I  R  I  H  H  R  H  Q  S  H  T  M  Y  *  I  T  F  *

14341  AAACAATTACTATCAATATCTGTTAAGCTAGAACATGTCATACTAAAATGACTAATGTTC  14400
         N  T  L  S  L  *  L  C  N  S  R  T  C  Y  S  K  V  S  *  L
          I  Q  *  H  Y  N  Y  V  I  R  D  Q  V  T  H  N  *  Q  N  C
           K  N  I  I  T  I  S  L  E  I  K  Y  L  I  I  K  S  I  V  L

14401  AATCTCAACAAATTATTCATAAAATTCATAACCCCATACTTCATAGTAGGATTATGACAC  14460
         N  S  N  N  L  L  Y  K  L  Y  Q  P  I  F  Y  *  G  L  V  T
          T  L  T  T  *  Y  T  N  *  T  N  P  Y  S  T  D  D  *  Y  Q
           *  L  Q  K  I  L  I  K  L  I  P  T  H  L  I  M  R  I  S  H

14461  CTAACACTATTACTATCCACATAATAAGTAACACGATTAAAATTATATGATAAATCATAC  14520
         S  Q  S  L  S  L  H  I  I  *  Q  A  L  K  L  I  S  N  L  I
          P  N  H  Y  H  Y  T  Y  *  E  N  H  *  N  *  Y  V  I  *  Y
           I  T  I  I  I  P  T  N  N  M  T  S  I  K  I  Y  *  K  T  H

14521  CAAAATGGATTATGAACAAAACCAGGGGAACAATCTGTTTAAAAACATCTACCACATGGC  14580
         T  K  G  L  V  Q  K  P  G  R  T  L  C  I  K  T  S  P  T  G
          P  K  V  *  Y  K  N  Q  D  G  Q  *  V  F  K  Q  L  H  H  V
           N  *  R  I  S  T  K  T  G  K  N  S  L  N  K  Y  I  T  Y  R
```

FIG. 3 CONT'D

```
14581  AAACAACAAAGATAACCAATGGTAATGTTTCTCAATCCACATCAATACTTGAATCTACAA  14640
         N  T  T  E  I  P  *  W  *  L  S  N  P  T  T  I  F  K  S  T
        T  Q  Q  K  *  Q  N  G  N  C  L  T  L  H  L  *  S  S  L  H
          K  N  N  R  N  T  V  M  V  F  L  *  T  Y  N  H  V  *  I  N

14641  CTGTGTGTGGCAATAGCAAACAGAGAATTTCTAAATGAAGAAATACGTCGTCTAGGACGA  14700
         S  V  C  R  *  R  K  D  R  L  S  K  S  R  *  A  A  S  G  A
        Q  C  V  G  N  D  N  T  E  *  L  N  V  E  K  H  L  L  D  Q
          V  C  V  T  I  T  Q  R  K  F  I  *  K  K  I  C  C  I  R  S

14701  TACGTGCAACGTAGACGATCACGAGACGAACTAAATGCTTGAACAACAAAATCACATCGA  14760
         I  C  T  A  D  A  L  A  R  S  S  K  R  V  Q  Q  K  L  T  A
        *  A  R  Q  M  Q  *  H  E  A  Q  N  V  F  K  N  N  *  H  L
          H  V  N  C  R  S  T  S  Q  K  I  *  S  S  T  T  K  T  Y  S

14761  CGGTAATGTTCACCATATTTTAAAGTTTGACATTTTGGTCCATTGAAATTGGTTCTGAAA  14820
         A  M  V  L  P  I  F  N  *  V  T  F  G  P  L  K  L  W  S  K
        Q  W  *  L  H  Y  L  I  E  F  Q  L  V  L  Y  S  *  G  L  S
          G  N  C  T  T  Y  F  K  L  S  Y  F  W  T  V  K  V  L  V  K

14821  ATGCTCAAACAATTTTCATTTCCGAACAAATTTCTCCCATCATGTCAACTAAACTTTGTA  14880
         *  S  N  T  L  L  P  K  N  L  S  P  L  V  T  S  K  F  C
        K  R  T  Q  *  F  Y  L  S  T  *  L  P  Y  Y  L  Q  N  S  V
          V  L  K  N  F  T  F  A  Q  K  F  L  T  T  C  N  I  Q  F  M

14881  AAAAAGAAATGAGTTCTACCATTACGACGTTAATGACTAATATTAATAATATTCATATTA  14940
         K  K  K  V  *  S  P  L  A  A  I  V  S  *  L  *  *  L  Y  L
        N  K  R  *  E  L  H  Y  H  Q  L  *  Q  N  Y  N  N  Y  T  Y
          K  E  K  S  L  I  T  I  S  C  N  S  I  I  I  I  L  I  I

14941  AATGGATGATACCAACTATAATTCGTCAATAACAAACATAATCTTCAACAAATATTTATA  15000
         K  G  V  I  T  S  I  L  C  N  N  N  T  N  S  T  T  *  L  Y
        N  V  *  *  P  Q  Y  *  A  T  I  T  Q  I  L  L  Q  K  Y  I
          *  R  S  H  N  I  N  L  L  *  Q  K  Y  *  F  N  N  I  F  I

15001  AAACTTTAAATACTACCACCAACATATGGTCGTAGTGTTCAATAACAATTATTAATACTA  15060
         K  S  I  *  S  P  P  Q  I  G  A  D  C  T  I  T  L  L  *  S
        N  Q  F  K  H  H  H  N  Y  V  L  M  V  L  *  Q  *  Y  N  H
          K  F  N  I  I  T  T  T  Y  W  C  *  L  N  N  N  I  I  I  I

15061  TTTTCACGACCAATAGGTAAATTATTTAAACCATTTCGGTCTGAAATAATACTCCGTAAT  15120
         L  L  A  P  *  G  N  L  L  N  P  L  A  L  S  *  *  S  A  N
        Y  F  H  Q  N  D  M  *  Y  I  Q  Y  L  W  V  K  N  H  P  M
          F  T  S  T  I  W  K  I  F  K  T  F  G  S  K  I  I  L  C  *
```

FIG. 3 CONT'D

```
15121  AGTAAACTCCTTGTCTTACTTTAAATACGTATATGATTTGCATTACAAGACGGGTGGAAT  15180
         D  N  S  S  C  F  S  I  *  A  Y  V  L  R  L  T  R  G  V  K
        I  M  Q  P  V  S  H  F  K  H  M  Y  *  V  Y  H  E  A  W  R
          *  K  L  F  L  I  F  N  I  C  I  S  F  T  I  N  Q  G  G  *

15181  TGAGTTTACTTAAATTTTATACGATAGTCACGATTCTTATCTCGAGCGTGACATCGTCCA  15240
         V  *  I  F  K  F  Y  A  I  L  A  L  F  L  A  R  V  T  A  P
        L  E  F  S  N  L  I  H  *  *  H  *  S  Y  L  E  C  Q  L  L
          S  L  H  I  *  F  I  S  D  T  S  L  I  S  S  A  S  Y  C  T

15241  CAAAGATAAGAATCATGATACTGTCCGGCTTACAAGGTAGTTTTTACAAACTTCTCATAT  15300
         T  E  I  R  L  V  I  V  P  R  I  N  W  *  F  H  K  F  L  I
        H  K  *  E  *  Y  *  S  L  G  F  T  G  D  F  I  N  S  S  Y
          N  R  N  K  T  S  H  C  A  S  H  E  M  L  F  T  Q  L  T  Y

15301  CGTCGATGGGCTCCACAAGGACAACAATATCCTTGGTGATTTAAAATACCACCAACCCTG  15360
         A  A  V  R  P  T  G  T  T  I  P  V  V  L  N  *  P  P  Q  S
        L  L  *  G  L  H  E  Q  Q  *  L  F  W  *  I  K  H  H  N  P
          C  S  G  S  T  N  R  N  N  Y  S  G  S  F  K  I  T  T  P  V

15361  CTATACAATGCAGTAGAATATTTCCTACAACTGTTGGGACAAGAATACCCAACCCTAATA  15420
         S  I  N  R  *  R  I  F  S  T  S  L  G  T  R  I  P  Q  S  *
        R  Y  T  V  D  D  *  L  P  H  Q  C  G  Q  E  *  P  N  P  N
          I  H  *  T  M  K  Y  L  I  N  V  V  R  N  K  H  T  P  I  I

15421  GGATTTACACTAGCACGATACGGTTTATAAAACGCATAACAATCATCAAATCAAAACCGG  15480
         G  L  H  S  R  A  I  G  F  I  K  R  I  T  L  L  K  T  K  A
        D  *  I  H  D  H  *  A  L  Y  K  A  Y  Q  *  Y  N  L  K  P
          R  F  T  I  T  S  H  W  I  N  Q  T  N  N  T  T  *  N  Q  G

15481  GCGTTTGTACTTAAAACAACAAGTGTACCACTATCTAAAATAGCGGAACGCTTACTTACA  15540
         R  L  C  S  N  Q  Q  E  C  P  S  L  N  *  R  R  A  F  S  H
        G  C  V  H  I  K  N  N  V  H  H  Y  I  K  D  G  Q  S  H  I
          A  F  M  F  K  T  T  *  M  T  I  S  K  I  A  K  R  I  F  T

15541  CGAGTTCAAAACTCACTTTATCAATACACACCGCCAACGATAATACAATTCGGACCACCA  15600
         A  *  T  K  L  S  I  T  I  H  P  P  Q  *  *  T  L  G  P  P
        H  E  L  K  S  H  F  L  *  T  H  R  N  S  N  H  *  A  Q  H
          S  L  N  Q  T  F  Y  N  H  T  A  T  A  I  I  N  L  R  T  T

15601  TGATCGTCACCACTACGTTGATGACGAAAACGATTAAGACAAAAATTATATACAGTCCGA  15660
         V  L  L  P  S  A  V  V  A  K  A  L  E  T  K  L  I  H  *  A
        Y  *  C  H  H  H  L  *  Q  K  Q  *  N  Q  K  *  Y  I  D  P
          S  A  T  T  I  C  S  S  S  K  S  I  R  N  K  I  Y  T  L  S
```

FIG. 3 CONT'D

```
15661  CAATGACGATTACAAACAAGAGAATACCGGACATTACCGGTATTCTAACTTCTAAATTCA  15720
         T  V  A  L  T  Q  E  R  I  A  Q  L  P  W  L  I  S  S  K  L
        Q  *  Q  *  H  K  N  E  *  P  R  Y  H  G  Y  S  Q  L  N  L
          N  S  S  I  N  T  R  K  H  G  T  I  A  M  L  N  F  I  *  T

15721  TATGCGTTAAATGTTTTTGCGAATATGAGATTACAAATAGCATGTCTAATACAACTAATA  15780
         I  R  L  K  C  F  R  K  Y  E  L  T  *  R  V  S  *  T  S  *
        Y  V  C  N  V  F  V  S  I  S  *  H  K  D  Y  L  N  H  Q  N
          Y  A  I  *  L  F  A  *  V  R  I  N  I  T  C  I  I  N  I  I

15781  TGTAAACAATTACTCATAATACTTAAAAATACATTCGTAAAATCATACTACTAAAACTCA  15840
         V  N  T  L  S  Y  *  S  N  K  H  L  C  K  L  I  I  I  K  L
        Y  M  Q  *  H  T  N  H  I  K  I  Y  A  N  *  Y  S  S  K  S
          C  K  N  I  L  I  I  F  K  *  T  L  M  K  T  H  H  N  Q  T

15841  CTACTACCACAACAGACAATATTGAGACTAATACGATCATTCCCAATATATCGATTATAT  15900
         S  S  P  T  T  Q  *  L  E  S  *  A  L  L  P  *  I  A  L  I
        H  H  H  H  Q  R  N  Y  S  Q  N  H  *  Y  P  N  Y  L  *  Y
          I  I  T  N  D  T  I  V  R  I  I  S  T  L  T  I  Y  S  I  Y

15901  TCACAAAAAGTTGTTCAAAACATGATAGTCTTATTACAGAAATACAGACTTAGATTTACA  15960
         L  T  K  *  C  T  K  Y  *  *  F  L  T  K  I  D  S  D  L  H
        L  H  K  E  V  L  K  T  S  D  S  Y  H  R  *  T  Q  I  *  I
          T  N  K  L  L  N  Q  V  I  L  I  I  D  K  H  R  F  R  F  T

15961  ACCCAACTTTTACTATAATGATTACCAGGAGTACTTAAAACAAGGGTTGTATGATACAAT  16020
         Q  T  S  F  S  I  V  L  P  G  *  S  N  Q  E  W  C  V  I  N
        N  P  Q  F  H  Y  *  *  H  D  E  H  I  K  N  G  V  Y  *  T
          P  N  F  I  I  N  S  I  T  R  M  F  K  T  G  L  M  S  H  *

16021  CAATTCTATCTACCACTAATACAAATAAATGGTATAGGTCTAGGAAGATCTTAAAATCCT  16080
         T  L  I  S  P  S  *  T  *  K  G  Y  G  S  G  E  L  I  K  P
        L  *  S  L  H  H  N  H  K  N  V  M  D  L  D  K  *  F  K  L
          N  L  Y  I  T  I  I  N  I  *  W  I  W  I  R  R  S  N  *  S

16081  CGACCAACAAAACAACTACTAAATAACTTCTGACTGTCACAAGAAAACTATCTCGCGAAA  16140
         A  P  Q  K  T  S  S  K  N  F  V  S  L  T  R  K  I  S  R  K
        L  Q  N  N  Q  Q  H  N  I  S  S  Q  C  H  E  K  S  L  A  S
          S  T  T  K  N  I  I  *  Q  L  S  V  T  N  K  Q  Y  L  A  K

16141  CATTCAGATCGATATCTACGAATGGGAAATCATGTAGTACTTTTACTTCTTATGGTTTTT  16200
         T  L  R  A  I  S  A  *  G  K  T  C  *  S  F  S  S  Y  W  F
        Q  L  D  L  *  L  H  K  G  K  L  V  D  H  F  H  L  I  G  F
          Y  T  *  S  Y  I  S  V  R  *  Y  M  M  F  I  F  F  V  L  F
```

FIG. 3 CONT'D

```
16201  CAGAAAGCACATATAAATCTTATATATTTTTTGACATATTACTAGAACCATGAGTCTAG  16260
         T  K  R  T  Y  K  S  Y  I  F  F  S  Y  L  S  R  P  V  *  I
        L  R  E  H  I  N  L  I  Y  L  F  V  T  Y  H  D  Q  Y  E  S
          D  K  T  Y  I  *  F  I  Y  F  F  Q  I  I  I  K  T  S  L  D

16261  AATCTATCAATATCACAATAAAATTCATGAACACTACCAAATTTCAAATGACTTCTTAGT  16320
         K  S  L  *  L  T  I  K  L  V  Q  S  P  K  F  N  V  S  S  D
        R  L  Y  N  Y  H  *  K  L  Y  K  H  H  N  L  T  *  Q  L  I
          *  I  T  I  T  N  N  *  T  S  T  I  T  *  L  K  S  F  F  *

16321  AAAATGTTCTTATACATAAATTTTTCACGGCACTACGTCTCACATCCACGTACGCAACAA  16380
         N  *  L  F  I  Y  K  F  L  A  T  I  C  L  T  P  A  H  T  T
        M  K  C  S  Y  T  N  L  F  H  R  S  A  S  H  L  H  M  R  Q
          K  V  L  I  H  I  *  F  T  G  H  H  L  T  Y  T  C  A  N  N

16381  ACAAGTAGTGTTTGAAGAAACGCAACACCGTCAACATATGCATTCGGAAACAATACAACA  16440
         Q  E  D  C  V  E  K  R  Q  P  L  Q  I  R  L  G  K  N  H  Q
        K  N  M  V  F  K  K  A  N  H  C  N  Y  V  V  Y  A  K  T  I  N
          T  *  *  L  S  R  Q  T  T  A  T  T  Y  T  L  R  Q  *  T  T

16441  TTTACAACAATACTGGTACAATACCGTTGATTAGTATTTATACAAAACTCACAGAGTGGA  16500
         L  H  Q  *  S  W  T  I  A  V  L  *  L  Y  T  K  L  T  E  G
        Y  I  N  N  H  G  H  *  P  L  *  D  Y  I  H  K  S  H  R  V
          F  T  T  I  V  M  N  H  C  S  I  M  F  I  N  Q  T  D  *  R

16501  ATGCAAACATTACGTGGATTGACACTACACTCACTACAGTGGTTTAATATAAACCCGCCA  16560
         *  T  Q  L  A  G  L  Q  S  T  L  S  T  V  L  N  Y  K  P  P
        K  R  K  Y  H  V  *  S  H  H  S  H  H  *  W  I  I  N  P  R
          V  N  T  I  C  R  V  T  I  H  T  I  D  G  F  *  I  Q  A  T

16561  TACAGAATGATAACACTTTTGGTATTTGGGGTAATAAGTAAATTCAATCAATACTTACCA  16620
         I  D  *  *  Q  S  F  W  L  G  W  *  E  N  L  N  T  I  F  P
        Y  T  K  S  N  H  F  G  Y  V  G  N  N  M  *  T  L  *  S  H
          H  R  V  I  T  F  V  M  F  G  M  I  *  K  L  *  N  H  I  T

16621  TACCAGAAACCAAACATATTTGTTAGAACGTGCCCAAGTGGAATATATCTACTAAAATTA  16680
         I  T  K  P  K  Y  L  C  D  Q  V  P  E  G  *  I  S  S  K  L
        Y  P  R  Q  N  T  Y  V  I  K  C  P  N  V  K  Y  L  H  N  *
          H  D  K  T  Q  I  F  L  R  A  R  T  *  R  I  Y  I  I  K  I

16681  TTCTATCGATCAACATTTACCTGTCTTCAACTACTAATACAAGACCGTTTACTCACATAA  16740
         L  I  A  L  Q  L  H  V  S  T  S  S  *  T  R  A  F  S  H  I
        Y  S  L  *  N  Y  I  S  L  L  Q  H  N  H  E  P  L  H  T  Y
          L  Y  S  T  T  F  P  C  F  N  I  I  I  N  Q  C  I  L  T  N
```

FIG. 3 CONT'D

```
16741  CTTGCAAATTTCAATAAACGACGTCTTTGAGTTTTCCGTTGACTTCTCCGAAAATTTGTT  16800
         S  R  K  F  N  N  A  A  S  V  *  F  A  V  S  S  A  K  L  C
          Q  V  N  L  T  I  Q  Q  L  F  E  F  P  L  Q  L  P  K  *  V
           F  T  *  L  *  K  S  C  F  S  L  L  C  S  F  L  S  K  F  L

16801  TCGATACGAAGACGATGGTAAGTTCTCTAACAATCACTATCTCTTCAATAAAACACAACC  16860
         L  *  A  E  A  V  M  *  S  I  T  L  S  L  S  T  I  K  H  Q
          F  S  H  K  Q  *  W  E  L  S  Q  *  H  Y  L  L  *  K  T  N
           A  I  S  R  S  G  N  L  L  N  N  T  I  S  F  N  N  Q  T  P

16861  CTCTGTCCATTTCAATTTGGTGGTGAATTATTTTTAATACAAAAGTGTCCGATGGTAAAA  16920
         S  V  P  L  T  L  G  G  S  L  L  F  *  T  K  V  P  *  W  K
          P  S  L  Y  L  *  V  V  V  *  Y  F  N  H  K  *  L  S  G  N
           L  C  T  F  N  F  W  W  K  I  F  I  I  N  E  C  A  V  M  K

16921  TGATCATGACCATTCTGTCAAAATCCACTCATACAAAAACTATTTTCACTTAATTGATTG  16980
         V  L  V  P  L  V  T  K  P  S  Y  T  K  S  L  L  S  N  V  L
          *  *  Y  Q  Y  S  L  K  L  H  T  H  K  Q  Y  F  H  I  L  *
           S  T  S  T  L  C  N  *  T  L  I  N  K  I  F  T  F  *  S  V

16981  CCACACATAATGGCGCGATGTTGATGAATATTTGAAAGATATCCACTACAAAAACAAAAT  17040
         P  T  Y  *  R  A  V  V  V  *  L  S  E  I  P  S  T  K  T  K
          R  H  T  N  G  R  *  L  *  K  Y  V  K  *  L  H  H  K  Q  K
           T  H  I  V  A  S  C  S  S  I  F  K  R  Y  T  I  N  K  N  *

17041  TGTAGTGTAAGACATCGATCAAATTCACGTGGATGTGAACAGGGTGTTCTCTTGATACGA  17100
         V  D  C  E  T  A  L  K  L  A  G  V  S  T  G  C  S  F  *  A
          L  M  V  N  Q  L  *  N  L  H  V  *  V  Q  G  V  L  S  S  H
           C  *  M  R  Y  S  T  *  T  C  R  C  K  D  W  L  L  V  I  S

17101  TCATATTCTAAAAGATCACAAATATCACAAGGTAACCACAAAGTTTTATTACAACGATTA  17160
         L  I  L  N  E  L  T  *  L  T  G  N  T  N  *  F  L  T  A  L
          *  Y  L  I  K  *  H  K  Y  H  E  M  P  T  E  F  Y  H  Q  *
           T  Y  S  K  R  T  N  I  T  N  W  Q  H  K  L  I  I  N  S  I

17161  ATAGTCGTGTAACCTTACTTTGCAATAACGTGACAAGTTCCAGGGGGACCATGCCCTTTC  17220
         *  *  C  M  P  I  F  R  *  Q  V  T  *  P  G  G  P  V  P  F
          N  D  A  C  Q  F  S  V  N  N  C  Q  E  L  D  G  Q  Y  P  F
           I  L  V  N  S  H  F  T  I  A  S  N  L  T  G  R  T  R  S  L

17221  AGAGTAGAACGATATCCAGATCGACAAATAATGATGTGTCGTGCACATCAAATATGACGA  17280
         D  *  R  A  I  P  R  A  T  *  *  *  V  A  R  T  T  *  V  A
          T  E  D  Q  *  L  D  L  Q  K  N  S  C  L  V  H  L  K  Y  Q
           R  M  K  S  Y  T  *  S  N  I  V  V  C  C  T  Y  N  I  S  S
```

FIG. 3 CONT'D

```
17281  CGATCAGTACGACGACATCTACGTAACACACTTTTTCGAATATTCAAAAATTTATAATTG  17340
        A  L  *  A  A  T  S  A  N  H  S  F  A  *  L  N  K  F  I  L
        Q  *  D  H  Q  Q  L  H  M  T  H  F  L  K  Y  T  K  L  Y  *
           S  T  M  S  S  Y  I  C  Q  T  F  F  S  I  L  K  *  I  N  V

17341  CTAACATGTGCATAATAAGGACGATTTCAAGCACATCTAACAATACTATTCAAATTTTAA  17400
        S  Q  V  R  I  I  G  A  L  T  R  T  S  Q  *  S  L  N  L  I
        R  N  Y  V  Y  *  E  Q  *  L  E  H  L  N  N  H  Y  T  *  F
           I  T  C  T  N  N  R  S  F  N  T  Y  I  T  I  I  L  K  F  N

17401  TTACTATGGTGAACATTCATACAAAAATGGTGTTATTTACGTAATGGTCTCAACCAATGT  17460
        L  S  V  V  Q  L  Y  T  K  V  V  I  F  A  N  G  S  N  T  V
        *  H  Y  W  K  Y  T  H  K  *  W  L  L  H  M  V  L  T  P  *
           I  I  G  S  T  L  I  N  K  G  C  Y  I  C  *  W  L  Q  N  C

17461  CTATAACAACAACAACTACTTCAATCATACGAATGATTAATACTTAACAGACAATATTTA  17520
        S  I  T  T  T  S  S  T  L  I  S  V  L  *  S  N  D  T  I  F
        L  Y  Q  Q  Q  Q  H  L  *  Y  A  *  *  N  H  I  T  Q  *  L
           I  N  N  N  N  I  F  N  T  H  K  S  I  I  F  Q  R  N  Y  I

17521  CGAGCATAATTTCGATTTGTAATACATATATAACCTCTAGGACGAGTTAATGGACGTGGT  17580
        A  R  I  L  A  L  C  *  T  Y  I  P  S  G  A  *  N  G  A  G
        H  E  Y  *  L  *  V  N  H  I  Y  Q  L  D  Q  E  I  V  Q  V
           S  T  N  F  S  F  M  I  Y  I  N  S  I  R  S  L  *  R  C  W

17581  GCACACGACAACTCGTTCCCAAGAAATCTTGGATCCGTGAAGTTAAGATAATGATTTTAT  17640
        R  T  S  N  L  L  P  E  K  S  G  L  C  K  L  E  I  V  L  I
        V  H  A  T  S  C  P  N  K  L  V  *  A  S  *  N  *  *  *  F
           T  H  Q  Q  A  L  T  R  *  F  R  P  V  E  I  R  N  S  F  Y

17641  TACACAACAAATCCAGGACTATAGAAAAACCCTTTAACAATATCCACAGGATTTCTTTAA  17700
        I  H  Q  K  P  G  S  I  K  K  P  F  Q  *  L  H  G  L  S  I
        L  T  N  N  L  D  Q  Y  R  K  P  F  N  N  Y  T  D  *  L  F
           H  T  T  *  T  R  I  D  K  Q  S  I  T  I  P  T  R  F  F  N

17701  CATCTTTGACAAAGTCGTAACCAAATACTATTATTTGAGTTCCGATTTTTACTATTATCA  17760
        T  S  V  T  E  A  N  T  *  S  L  L  S  L  A  L  F  S  L  L
        Q  L  F  Q  K  L  M  P  K  H  Y  Y  V  *  P  *  F  H  Y  Y
           Y  F  S  N  *  C  Q  N  I  I  I  F  E  L  S  F  I  I  I  T

17761  AGTAATACAAAATTTCATATAAAATTCCCTGTCTGTTGTGTACTCTCAAGTTCACGACAT  17820
        E  N  H  K  L  T  Y  K  L  P  C  V  V  C  S  L  E  L  A  T
        N  M  I  N  *  L  I  N  *  P  V  S  L  V  H  S  N  L  H  Q
           *  *  T  K  F  Y  I  K  L  S  L  C  C  M  L  T  *  T  S  Y
```

FIG. 3 CONT'D

```
17821  TTATAAGTTGTCTATATAGATTAATCATTTAAAAATTTTCGATTAGGTCAAACCTTATCA  17880
          F  I  *  C  I  Y  R  I  L  L  N  K  F  A  L  G  T  Q  F  L
         L  Y  E  V  S  I  D  L  *  Y  I  K  L  L  *  D  L  K  S  Y
            I  N  L  L  Y  I  *  N  T  F  K  *  F  S  I  W  N  P  I  T

17881  CGACAAAAATAATCAGGAATATTATCAGTCTTAATACAACGATTCGCACAAAATCCACAA  17940
          A  T  K  I  L  G  *  L  L  *  F  *  T  A  L  R  T  K  P  T
         H  Q  K  *  *  D  K  Y  Y  D  S  N  H  Q  *  A  H  K  L  H
            S  N  K  N  T  R  I  I  T  L  I  I  N  S  L  T  N  *  T  N

17941  GTTTGTGTTTGACATCTAAGACGAGTTCCAAGCCTTATACTAATACAATATATAAGTGTT  18000
          *  V  C  V  T  S  E  A  *  P  E  S  Y  S  *  T  I  Y  E  C
         E  F  V  F  Q  L  N  Q  E  L  N  P  I  H  N  H  *  I  N  V
            L  C  L  S  Y  I  R  S  L  T  R  F  I  I  I  N  Y  I  *  L

18001  TGTCGTCTTTGTCGGGTAAGACAATTACAATTAGCTAAATTACAACGGTATTGATCTCGG  18060
          V  A  S  V  A  W  E  T  L  T  L  R  N  L  T  A  M  V  L  A
         F  L  L  F  L  G  N  Q  *  H  *  D  I  *  H  Q  W  L  *  L
            C  C  F  C  G  M  R  N  I  N  I  S  K  I  N  G  Y  S  S  G

18061  TTCTTCCCGTAAAAAACACAATACTCATTATACGTTAATAAACTTAGAGAATTAAAATAA  18120
          L  F  P  M  K  Q  T  I  L  L  I  C  N  N  S  D  R  L  K  I
         W  S  P  C  K  K  H  *  S  Y  Y  A  I  I  Q  I  E  *  N  *
            L  L  A  N  K  T  N  H  T  I  H  L  *  K  F  R  K  I  K  N

18121  TGAGATGGAAATCTATTTTAAGTTTTAGTTTGAAATGGAGCAAACGTAACGTGTTGATTA  18180
          V  R  G  K  S  L  I  *  F  *  V  K  G  R  K  C  Q  V  V  L
         *  E  V  K  L  Y  F  E  F  D  F  K  V  E  N  A  N  C  L  *
            S  *  R  *  I  F  N  L  I  L  S  *  R  T  Q  M  A  C  S  I

18181  GAAAAATTTCTAACATCATTTTCAACGAATCCAATAGTAGGTCGCGTACGGGGGAGTAAA  18240
          R  K  L  S  Q  L  L  L  Q  K  P  *  *  G  A  C  A  G  E  N
         D  K  *  L  N  Y  Y  F  N  S  L  N  D  D  L  A  H  G  R  M
            K  K  F  I  T  T  F  T  A  *  T  I  M  W  R  M  G  G  *  K

18241  AATCGTCAACTACTATTTATATTCCAATTACTTTTAAACCGACATTTAAATTTATAAACA  18300
          K  A  T  S  S  L  Y  L  T  L  S  F  K  A  T  F  K  F  I  Q
         K  L  L  Q  H  Y  I  Y  P  *  H  F  N  P  Q  L  N  L  Y  K
            *  C  N  I  I  F  I  L  N  I  F  I  Q  S  Y  I  *  I  N  T

18301  CTTGGACAAAATTGTATAAGAGCAAATTATAGAGAATACCCAAAATTTAATCTAAACTGA  18360
          S  G  T  K  V  Y  E  R  K  I  D  R  I  P  K  L  N  S  K  V
         H  V  Q  K  L  M  N  E  N  L  I  E  *  P  N  *  I  L  N  S
            F  R  N  *  C  I  R  T  *  Y  R  K  H  T  K  F  *  I  Q  S
```

FIG. 3 CONT'D

```
18361  GAACTACCAATAAGATTTAACAAATAATGATTTCTACTTCGGTAATTTGCACAATCTCCA  18420
          R  S  P  *  E  L  N  N  I  V  L  S  S  A  M  L  R  T  L  P
         E  Q  H  N  N  *  I  T  *  *  *  L  H  L  W  *  V  H  *  L
            K  I  T  I  R  F  Q  K  N  S  F  I  F  G  N  F  T  N  S  T

18421  ACCCAACCAAAACTACAACTCCCGCGAGTACGATGAGCGCTTTTGTAACCTTGTTTGAAA  18480
          Q  T  P  K  S  T  S  P  A  *  A  V  R  S  F  M  P  V  F  K
         N  P  Q  N  Q  H  Q  P  R  E  H  *  E  R  F  C  Q  F  L  S
            P  N  T  K  I  N  L  A  S  M  S  S  A  F  V  N  S  C  V  K

18481  GGTGACGTTTATCCAAAAAGTTGACCACACCTAAAACATCAACTTCGATGACCGAATAAA  18540
          G  S  C  I  P  K  E  V  P  T  S  K  T  T  S  A  V  P  K  N
         E  V  A  F  L  N  K  L  Q  H  P  N  Q  L  Q  L  *  Q  S  I
            W  Q  L  Y  T  K  *  S  T  H  I  K  Y  N  F  S  S  A  *  K

18541  CGACTCTCTCTAACAATATGAAAATTTTTTTGACATCGATTTCGAGGAGGACCACTTTTT  18600
          A  S  L  S  Q  *  V  K  L  F  V  T  A  L  A  G  G  P  S  F
         Q  Q  S  L  N  N  Y  K  *  F  F  Q  L  *  L  E  E  Q  H  F
            S  L  S  I  T  I  S  K  F  F  S  Y  S  F  S  R  R  T  F  F

18601  AAATTTGTAAATTATGGGGAATACAGTTTTCCAGTTTTCACCCTATAACAATCTTAATCT  18660
          N  L  C  K  I  G  R  I  D  F  P  *  F  H  S  I  T  L  I  L
         I  *  V  N  L  V  G  *  T  L  L  D  F  T  P  Y  Q  *  F  *
            K  F  M  *  Y  G  K  H  *  F  T  L  L  P  I  N  N  S  N  S

18661  TAACAAGTTTACAATAGACTAATAGAAAATCTGGAAAGACTATCACATCATAAATAATGA  18720
          I  T  *  I  N  D  S  *  R  K  S  R  E  S  L  T  T  N  I  V
         F  Q  E  F  T  I  Q  N  D  K  L  G  K  Q  Y  H  L  I  *  *
            N  N  L  H  *  R  I  I  K  *  V  K  R  I  T  Y  Y  K  N  S

18721  ACCAGACGGTCAAAACTTGAATGAACAAATTCCATAAAACGATTTAATCCGTCTCTCGAA  18780
          Q  D  A  L  K  S  S  V  Q  K  L  Y  K  A  L  N  P  L  S  S
         K  T  Q  W  N  Q  V  *  K  N  L  T  N  Q  *  I  L  C  L  A
            P  R  G  T  K  F  K  S  T  *  P  I  K  S  F  *  A  S  L  K

18781  TTAACATTACACACAAGATTAGCACGATGTACGATGTTAAGATCTTGACCAATAATACCA  18840
          L  Q  L  T  H  E  L  R  A  V  H  *  L  E  L  V  P  *  *  P
         *  N  Y  H  T  N  *  D  H  *  M  S  C  N  *  F  Q  N  N  H
            I  T  I  H  T  R  I  T  S  C  A  V  I  R  S  S  T  I  I  T

18841  ACAACCGCGGTATCAATATGAACACTAATACACATATTAGGTGAATAACATCTATATGTT  18900
          Q  Q  R  W  L  *  V  Q  S  *  T  Y  L  G  S  I  T  S  I  C
         N  N  A  G  Y  N  Y  K  H  N  H  T  Y  D  V  *  Q  L  Y  V
            T  P  A  M  T  I  S  T  I  I  H  I  I  W  K  N  Y  I  Y  L
```

FIG. 3 CONT'D

```
18901  GTCACCCCAATATGTCCAAGAAATTGATCATTAGTGCTATATTAAACATTACATGTATTT  18960
         C  H  P  *  V  P  E  K  V  L  L  *  S  I  I  Q  L  T  C  L
        V  T  P  N  Y  L  N  K  L  *  Y  D  R  Y  L  K  Y  H  V  Y
          L  P  T  I  C  T  R  *  S  T  I  V  I  Y  N  T  I  Y  M  F

18961  CCACGTGTACAACGCAGTCGACTACGTTAATACTGAGCAACAAATCGTTAGATACTAACA  19020
         P  A  C  T  A  D  A  S  A  I  I  V  R  Q  K  A  I  *  S  Q
        L  H  V  H  Q  T  L  Q  H  L  *  S  E  N  N  L  L  R  H  N
          T  C  M  N  R  *  S  I  C  N  H  S  T  T  *  C  D  I  I  T

19021  AAAACATTTAGACAATTAACCTTAAATCTCATAGGTTATTAAAGATTACTCCAGTCATAT  19080
         K  Q  L  D  T  L  Q  F  K  S  Y  G  I  I  E  L  S  T  L  I
        N  K  Y  I  Q  *  N  S  N  L  T  D  L  L  K  *  H  P  *  Y
          K  T  F  R  N  I  P  I  *  L  I  W  Y  N  R  I  L  D  T  Y

19081  TTATGTAGAACATCCAATAACGTCGCACAGTACGAATTTCGACGGTACGATACATTATCT  19140
         F  V  D  Q  L  N  N  C  R  T  M  S  L  A  A  M  S  H  L  L
        L  Y  M  K  Y  T  I  A  A  H  *  A  *  L  Q  W  A  I  Y  Y
          I  C  R  T  P  *  Q  L  T  D  H  K  F  S  G  H  *  T  I  S

19141  ATGTTGAATACAATACTGTATCCGTTAGGATTTCCAAATCGAACACAGTTTCTAATACTT  19200
         Y  L  K  H  *  S  M  P  L  G  L  P  K  A  Q  T  L  S  *  S
        I  C  S  I  N  H  C  L  C  D  *  L  N  L  K  H  *  L  N  H
          V  V  *  T  I  V  Y  A  I  R  F  T  *  S  T  D  F  I  I  F

19201  AAATTTAAAATACTACGAAAAGGACATCGGTTCAGACAATTTGTCAATAAAATACAGATA  19260
         N  L  N  *  S  A  K  G  T  A  L  D  T  L  C  N  N  *  T  *
        I  *  I  K  H  H  K  E  Q  L  W  T  Q  *  V  T  I  K  H  R
          K  F  K  I  I  S  K  R  Y  G  L  R  N  F  L  *  K  I  D  I

19261  CTACACGTATTTCTATTAAAATTTCTACCAAATACATACAAAACCTTAACATTACAACTA  19320
         S  T  C  L  S  L  K  L  S  P  K  H  I  N  Q  F  Q  L  T  S
        H  H  A  Y  L  Y  N  *  L  H  N  I  Y  T  K  S  N  Y  H  Q
          I  H  M  F  I  I  K  F  I  T  *  T  H  K  P  I  T  I  N  I

19321  TTTATAGGTAGATTAAGTTAACAAACATCTAAACTGTGAGCTCACAATTTATTTAATTTG  19380
         L  Y  G  D  L  E  I  T  Q  L  N  S  V  R  T  N  F  L  N  F
        Y  I  D  M  *  N  L  Q  K  Y  I  Q  C  E  L  T  L  Y  I  L
          F  I  W  R  I  *  N  N  T  S  K  V  S  S  H  *  I  F  *  V

19381  GAAGGACCTACATTACCACCATCAAACATACAATTATTTGTACGTAAGGTATGATTAGGA  19440
         R  G  P  H  L  P  P  L  K  Y  T  L  L  C  A  N  W  V  L  G
        G  E  Q  I  Y  H  H  Y  N  T  H  *  Y  V  H  M  G  Y  *  D
          K  R  S  T  I  T  T  T  Q  I  N  I  F  M  C  E  M  S  I  R
```

FIG. 3 CONT'D

```
19441  AAATGATCTTGACAAAAACTTTTAGAATTCGGATACGGAAAAAAGATAATAAGTCTATGC  19500
          K  V  L  V  T  K  S  F  R  L  G  I  G  K  K  *  *  E  S  V
         K  *  *  F  Q  K  Q  F  D  *  A  *  A  K  K  R  N  N  L  Y
           K  S  S  S  N  K  F  I  K  L  R  H  R  K  E  I  I  *  I  R

19501  GGAACACACATGCATCTACCAAATCTTAGATTTGTTCAACTAATGCAAGGAAATTCTTCG  19560
          G  Q  T  Y  T  S  P  K  S  D  L  C  T  S  *  T  G  K  L  L
         A  K  H  T  R  L  H  N  L  I  *  V  L  Q  N  R  E  K  L  F
           R  T  H  V  Y  I  T  *  F  R  F  L  N  I  V  N  R  *  S  A

19561  CGGTGAACATAGTGTGCCACATTAGATCCACCTCGACAAACAAGTTTCGTACGACTTCTT  19620
          A  V  Q  I  V  R  H  L  R  P  P  A  T  Q  E  F  C  A  S  S
         R  W  K  Y  *  V  T  Y  D  L  H  L  Q  K  N  L  A  H  Q  L
           G  S  T  D  C  P  T  I  *  T  S  S  N  T  *  L  M  S  F  F

19621  ATAACATTGATGGAACTCAGAATATTATATCAATGATGTCGTCCGAAATGAAAAACCCAA  19680
          Y  Q  L  *  R  S  D  *  L  I  T  V  V  A  P  K  V  K  Q  T
         I  N  Y  S  G  Q  T  K  Y  Y  L  *  *  L  L  S  *  K  K  P
           I  T  V  V  K  L  R  I  I  Y  N  S  C  C  A  K  S  K  P  N

19681  ATATTCTTAAAACTAAAAATATTAAATACCTTGTGAAAATGATGCAATGTCTCAAATCTT  19740
          *  L  F  K  S  K  *  L  K  H  F  V  K  V  V  N  C  L  K  S
         K  Y  S  N  Q  N  K  Y  N  I  S  C  K  *  *  T  V  S  N  L
           I  L  I  K  I  K  I  I  *  P  V  S  K  S  R  *  L  T  *  F

19741  TTGCATTATATATTGAACCAATTACAACCAGTAATACTACCTGCATGTCCACTTAATGGA  19800
          F  T  I  Y  L  K  T  L  T  P  *  *  S  P  R  V  P  S  N  G
         F  R  L  I  Y  S  P  *  H  Q  D  N  H  H  V  Y  L  H  I  V
           V  Y  Y  I  V  Q  N  I  N  T  M  I  I  S  T  C  T  F  *  R

19801  ACACGATAATACTTACTGTTTCAACAACAATTCTAATTATTACATCTATGACAATAAAAA  19860
          Q  A  I  I  F  S  L  T  T  T  L  I  L  L  T  S  V  T  I  K
         K  H  *  *  S  H  C  L  Q  Q  *  S  *  Y  H  L  Y  Q  *  K
           T  S  N  H  I  V  F  N  N  N  L  N  I  I  Y  I  S  N  N  K

19861  TTTTTATTATGTAGTAAAGGATGATTATATCGACAACTTAACAAATGTTTTGCATCATAG  19920
          L  F  L  V  D  N  G  V  L  I  A  T  S  N  N  V  F  R  L  I
         *  F  Y  Y  M  M  E  *  *  Y  L  Q  Q  I  T  *  L  V  Y  Y
           F  I  I  C  *  K  R  S  I  Y  S  N  F  Q  K  C  F  T  T  D

19921  GCCGTGGTGGGACTTGAATTCTAAGAATCTTTAAACTTGTAACTATAAACAACCTTCGTA  19980
          R  C  W  G  S  S  L  I  R  L  F  K  F  M  S  I  Q  Q  F  C
         G  A  G  G  Q  V  *  S  E  *  F  N  S  C  Q  Y  K  N  S  A
           P  V  V  R  F  K  L  N  K  S  I  Q  V  N  I  N  T  P  L  M
```

FIG. 3 CONT'D

```
19981  CAGGACACCCTAATACAATTTCTATCAAACAAAACATCAAGGTGAATACCACAAACATTT  20040
         T  R  H  S  *  T  L  S  L  K  N  Q  L  E  V  *  P  T  Q  L
          H  G  T  P  N  H  *  L  Y  N  T  K  Y  N  W  K  H  H  K  Y
            D  Q  P  I  I  N  F  I  T  Q  K  T  T  G  S  I  T  N  T  F

20041  ATGTGTCTAAACTTCAAGTAGCTTTTAAACTTATATGAAAAACTACCAGCACTGTGACCG  20100
         Y  V  S  K  F  N  M  S  F  K  F  I  S  K  S  P  R  S  V  P
          I  C  L  N  S  T  *  R  F  N  S  Y  V  K  Q  H  D  H  C  Q
            V  C  I  Q  L  E  D  F  I  Q  I  Y  K  K  I  T  T  V  S  A

20101  CGAAATCTTCGAAAATCTTTTCGTTCTTTACCACAAAAATAATCATGACTTTTTAATTCA  20160
         A  K  S  A  K  L  F  A  L  P  T  K  I  L  V  S  F  N  L
          R  K  L  L  K  *  F  L  L  F  H  H  K  *  *  Y  Q  F  I  L
            S  *  F  S  K  S  F  C  S  I  T  N  K  N  T  S  F  F  *  T

20161  TCCAATAGTTACTAATTTCCAGGCGTTGCTCGACTAAATTTACCACACTAACACCTATTT  20220
         L  N  D  I  I  L  P  G  C  R  A  S  K  F  P  T  I  T  S  L
          Y  T  I  L  S  *  L  D  A  V  L  Q  N  L  H  H  S  Q  P  Y
            P  *  *  H  N  F  T  R  L  S  S  I  *  I  T  H  N  H  I  F

20221  CAACCTCTTGAGTTTCAACTCAAAACCAAGCGATACTCTTTTCTACCACTGCTACAATAG  20280
         T  P  S  S  L  T  S  N  Q  N  A  I  L  F  S  P  S  S  T  I
          L  Q  L  V  *  L  Q  T  K  T  R  *  S  F  L  H  H  R  H  *
            N  S  F  E  F  N  L  K  P  E  S  H  S  F  I  T  V  I  N  D

20281  AAGTCGGCTTGTCTGTCGGATACGAGTTCGGTAATGACCTCGGGTGTTCCATTAGATCCA  20340
         K  L  R  V  S  L  R  H  E  L  W  *  Q  L  G  C  P  L  R  P
          R  *  G  F  L  C  G  I  S  L  G  N  S  S  G  V  L  Y  D  L
            E  A  S  C  V  A  *  A  *  A  M  V  P  A  W  L  T  I  *  T

20341  CCATTAACGCGCCCATTACAGTAACCATTACTACGAGATTGTGCAAAATGATAGAAATGA  20400
         P  L  Q  A  P  L  T  M  P  L  S  A  R  V  R  K  V  I  K  V
          H  Y  N  R  P  Y  H  *  Q  Y  H  H  E  L  V  N  *  *  R  *
            T  I  A  R  T  I  D  N  T  I  I  S  *  C  T  K  S  D  K  S

20401  GTCTCAGCACATAACAGTTCAAAACTTGGAGCGAGTCTAAATCTTGCCCTAAAATAACTA  20460
         *  L  R  T  N  D  L  K  S  G  R  E  S  K  S  R  S  K  I  S
          E  S  D  H  I  T  L  N  Q  V  E  S  L  N  L  V  P  N  *  Q
            L  T  T  Y  Q  *  T  K  F  R  A  *  I  *  F  P  I  K  N  I

20461  TACCTACTATTAGACAAATAACGATTTATACCAAATCTTCTGATACGTAAACTAGTATAT  20520
         I  S  S  L  R  N  I  A  L  Y  P  K  S  S  *  A  N  S  *  I
          Y  P  H  Y  D  T  *  Q  *  I  H  N  L  L  S  H  M  Q  D  Y
            H  I  I  I  Q  K  N  S  F  I  T  *  F  V  I  C  K  I  M  Y
```

FIG. 3 CONT'D

```
20521  CAAATACCATCAAAATTGGTATTTCAATATCCTCCAAACGTAAACGAATATCCGAATAAA  20580
         T  *  P  L  K  L  W  L  T  I  P  P  K  C  K  S  I  P  K  N
          L  K  H  Y  N  *  G  Y  L  *  L  L  N  A  N  A  *  L  S  I
            N  I  T  T  K  V  M  F  N  Y  S  T  Q  M  Q  K  Y  A  *  K

20581  GCATCCTTTTTTTTTAGATTAAACAATTAAGTTCTCAAAAATGTCATACTAAGATCATAA  20640
         R  L  F  F  F  D  L  K  N  I  *  S  N  K  C  Y  S  E  L  I
          E  Y  S  F  F  I  *  N  T  L  E  L  T  K  V  T  H  N  *  Y
            T  P  F  F  F  R  I  Q  *  N  L  L  K  *  L  I  I  R  T  N

20641  GTAAGTATAAAATAATGACTAGTCCTCACACCATCATCATTCTCACAAACATGTCAATAA  20700
         *  E  Y  K  I  V  S  *  S  H  P  L  L  L  L  T  Q  V  T  I
          E  N  M  N  *  *  Q  D  P  T  H  Y  Y  Y  S  H  K  Y  L  *
            M  *  I  K  N  S  I  L  L  T  T  T  T  L  T  N  T  C  N  N

20701  CTAAATAATAATCTACTAAAACAAAGATAACAATTCAGTAATTTAAACTCAACACAATCA  20760
         S  K  N  N  S  S  K  T  E  I  T  L  D  N  F  K  L  Q  T  L
          Q  N  I  I  L  H  N  Q  K  *  Q  *  T  M  L  N  S  N  H  *
            I  *  *  *  I  I  K  N  R  N  N  L  *  *  I  Q  T  T  N  T

20761  TTTCAACAATTATAATTACAACTAAAATTCCTAAAAGTTAAATACAACACCACATTACTA  20820
         L  T  T  L  I  L  T  S  K  L  S  K  *  N  I  N  H  H  L  S
          Y  L  Q  *  Y  *  H  Q  N  *  P  N  E  I  *  T  T  T  Y  H
            F  N  N  I  N  I  N  I  K  L  I  K  L  K  H  Q  P  T  I  I

20821  TTATTTTAATACTGAAAAATAGGATTTTACGTTCGGTGATTACTAACCTTTGGACCGATA  20880
         L  L  I  I  V  K  *  G  L  I  C  A  V  L  S  Q  F  G  P  *
          Y  Y  F  *  S  K  K  D  *  F  A  L  W  *  H  N  S  V  Q  S
            I  F  N  H  S  K  I  R  F  H  L  G  S  I  I  P  F  R  A  I

20881  AGATACGGACAAAACATATTCATAAACTTACAAGGTAATCTCTCTCAGAGAAATACCTTA  20940
         E  I  G  T  K  Y  L  Y  K  F  T  G  N  S  L  T  E  K  H  F
          N  *  A  Q  K  T  Y  T  N  S  H  E  M  L  S  L  R  K  I  S
            R  H  R  N  Q  I  L  I  Q  I  N  W  *  L  S  D  R  *  P  I

20941  ATACCATTTGGATAATTAAACGGATGTCCGACATACTACTTACAACGATTCATGTGAGTT  21000
         *  P  L  G  I  L  K  G  V  P  Q  I  I  F  T  A  L  Y  V  *
          N  H  Y  V  *  *  N  A  *  L  S  Y  S  S  H  Q  *  T  C  E
            I  T  F  R  N  I  Q  R  C  A  T  H  H  I  N  S  L  V  S  L

21001  AATACAGTCATAAACTTATGATGTTGTAATCGACAAGGACAATTATACGCACAAAATGTA  21060
         N  H  *  Y  K  F  V  V  V  N  A  T  G  T  L  I  R  T  K  C
          I  I  D  T  N  S  Y  *  L  M  L  Q  E  Q  *  Y  A  H  K  V
            *  T  L  I  Q  I  S  C  C  *  S  N  R  N  I  H  T  N  *  M
```

FIG. 3 CONT'D

```
21061  AATCCACGTCCCAGACTATTTCTTCATCGAGGTCCAAGACGACAAAATTCTGTCACCAAT  21120
        K  P  A  P  D  S  L  S  T  A  G  P  E  A  T  K  L  C  H  N
       N  L  H  L  T  Q  Y  L  L  L  E  L  N  Q  Q  K  L  V  T  T
         *  T  C  P  R  I  F  F  Y  S  W  T  R  S  N  *  S  L  P  *

21121  GGTAGACCATCATAAGAACATCTATTACTAAATTTGGGTAAACAATCGCTATCAAATCAA  21180
        G  D  P  L  I  R  T  S  L  S  K  F  G  N  T  L  S  L  K  T
       V  M  Q  Y  Y  E  Q  L  Y  H  N  L  G  M  Q  *  R  Y  N  L
         W  R  T  T  N  K  Y  I  I  I  *  V  W  K  N  A  I  T  *  N

21181  TGAATAAAACCTCTAACATACTGAAATGGTAAACTAACAGTAACCCTAAACTATTATAGA  21240
        V  *  K  P  S  Q  I  V  K  G  N  S  Q  *  Q  S  K  I  I  D
       *  K  N  Q  L  N  Y  S  K  V  M  Q  N  D  N  P  N  S  L  I
         S  I  K  S  I  T  H  S  *  W  K  I  T  M  P  I  Q  Y  Y  R

21241  CTATACATACTAGGAGAATGATTTTTATAACCACTAATATTACACTCATTCCTACCCAAA  21300
        S  I  Y  S  G  R  V  L  F  I  P  S  *  L  T  L  L  S  P  N
       Q  Y  T  H  D  E  *  *  F  Y  Q  H  N  Y  H  S  Y  P  H  T
         I  H  I  I  R  K  S  F  I  N  T  I  I  I  H  T  L  I  P  K

21301  AAATGAATGTAAACAGTAAATTAAGCACTATTTAATAGAAACCCACCATCACATCGATAT  21360
        K  V  *  M  Q  *  K  I  R  S  L  N  D  K  P  P  L  T  A  I
       K  *  K  C  K  D  N  L  E  H  Y  I  I  K  P  H  Y  H  L  *
         K  S  V  N  T  M  *  N  T  I  F  *  R  Q  T  T  T  Y  S  Y

21361  TTTTAATGTCTCAAAAGAACCTTACGACTAAATATATTTAATTACTCAACAAAACGTAAA  21420
        F  I  V  S  N  E  Q  F  A  S  K  Y  L  N  I  L  Q  K  A  N
       L  F  *  L  T  K  K  S  H  Q  N  I  Y  I  L  S  N  N  Q  M
         F  N  C  L  K  R  P  I  S  I  *  I  F  *  H  T  T  K  C  K

21421  ACCTGTCAAAAAACATGATTACATTTACGAAGAAGATCACTTCCCAAAAATTATCCATAT  21480
        Q  V  T  K  Q  V  L  T  F  A  E  E  L  S  P  N  K  I  P  I
       K  S  L  K  K  Y  *  H  L  H  K  K  *  H  L  T  K  L  L  Y
         P  C  N  K  T  S  I  Y  I  S  R  R  T  F  P  K  *  Y  T  Y

21481  TTAATGGACCCATTTAGAAGAAAACTTTATCTACCGTTACAATACGTACGATTGATAAAC  21540
        F  *  R  P  L  D  E  K  S  I  S  P  L  T  I  C  A  L  *  K
       L  N  G  P  Y  I  K  K  Q  F  L  H  C  H  *  A  H  *  S  N
         I  V  Q  T  F  R  R  K  F  Y  I  A  I  N  H  M  S  V  I  Q

21541  AAAACCTCTTTATCATGTTGTACCTTACCGCCACGAATATCAAATAAACTATACTGATTT  21600
        N  Q  L  F  L  V  V  H  F  P  P  A  *  L  K  N  S  I  V  L
       T  K  S  F  Y  Y  L  M  S  H  R  H  K  Y  N  I  Q  Y  S  *
         K  P  S  I  T  C  C  P  I  A  T  S  I  T  *  K  I  H  S  F
```

FIG. 3 CONT'D

```
21601  AAAAGAAACTTTAACCGACCGTGACGACAACAATTAAATTCTGGTCTAGTTAATTTACTA  21660
         N  E  K  F  N  A  P  V  A  T  T  L  K  L  G  S  *  N  F  S
          I  K  K  S  I  P  Q  C  Q  Q  Q  *  N  L  V  L  D  I  L  H
           K  R  Q  F  Q  S  A  S  S  N  N  I  *  S  W  I  L  *  I  I

21661  AATCAAATAAGAGAATAACTTTCTCCATTTAATAATCAAGCGCTATGCGCATTTCTCTAA  21720
         K  T  *  E  R  I  S  L  P  L  N  N  T  R  S  V  R  L  S  I
          N  L  K  N  E  *  Q  F  L  Y  I  I  L  E  R  Y  A  Y  L  S
           *  N  I  R  K  N  F  S  T  F  *  *  N  A  I  R  T  F  L  N

21721  AAACAACCACTATCAGAACATTTATGAACAATCTAGAGTAATTTAGATTTGATACAATTA  21780
         K  T  P  S  L  R  T  F  V  Q  *  I  E  N  F  R  F  *  T  L
          K  Q  Q  H  Y  D  Q  L  Y  K  N  S  R  M  L  D  L  S  H  *
           K  N  T  I  T  K  Y  I  S  T  L  D  *  *  I  *  V  I  N  I

21781  ATAAAAAAATAAAAAAATAAAGACAATACCAAAATTACTTGGAGAATTACAACACAGAGT  21840
         *  K  K  I  K  K  N  R  N  H  N  *  H  V  E  *  H  Q  T  E
          N  N  K  *  K  K  I  E  T  I  T  K  I  F  R  K  I  N  H  R
           I  K  K  N  K  *  K  Q  *  P  K  L  S  G  R  L  T  T  D  *

21841  AAATTTGGTACTGACCAAAAATAAACCACTATCAGCAAGACTAACATTGGTATAATTATT  21900
         N  L  G  H  S  T  K  I  Q  H  Y  D  N  Q  N  Y  G  Y  *  Y
          M  *  V  M  V  P  K  *  K  T  I  T  T  R  I  T  V  M  N  I
           K  F  W  S  Q  N  K  N  P  S  L  R  E  S  Q  L  W  I  L  L

21901  AAATTTTTAATTTTTAAAACTAATAAACCTATAAGTGGGATCAAACACGTTGTTACCATT  21960
         N  L  F  *  F  N  Q  N  N  P  Y  E  G  *  N  T  C  C  H  Y
          I  *  F  N  F  I  K  I  I  Q  I  N  V  R  T  Q  A  V  I  T
           K  F  I  L  F  K  S  *  K  S  I  *  G  L  K  H  L  L  P  L

21961  CTAAAGTAGATCACGGCCACTAAGATAAAAATTCTCAAAAGTAAAGTGAGCTAAAATATT  22020
         S  K  M  *  H  R  H  N  *  K  *  S  N  E  N  *  E  I  K  Y
          L  N  *  R  T  G  T  I  R  N  K  L  T  K  M  E  S  S  K  I
           I  E  D  L  A  P  S  E  I  K  L  L  K  *  K  V  R  N  *  L

22021  AATGTGACCGCTTCCACTAGTTTAATAAAAAATACTCCCACAATTAAAATTAGGAATAGT  22080
         N  C  Q  R  L  H  D  F  *  K  K  H  P  H  *  N  *  D  K  D
          I  V  S  A  F  T  I  L  N  N  K  I  L  T  N  I  K  I  R  I
           *  V  P  S  P  S  *  I  I  K  *  S  P  T  L  K  L  G  *  *

22081  ATCTAAATTCACAAAAGGATTACCATCATTACTACATACCGAAGAATTGTTCCATTCTAA  22140
         Y  I  *  T  N  E  *  H  Y  Y  H  H  I  A  E  *  C  P  L  I
          M  S  K  L  T  K  R  I  T  T  I  I  Y  P  K  K  V  L  Y  S
           L  N  L  H  K  G  L  P  L  L  S  T  H  S  R  L  L  T  L  N
```

FIG. 3 CONT'D

```
22141  AATAGCACGGAATATAAGATTATACCGGAAAAAAGCAATAGAATGAAAACAACTATAAGG  22200
         K   D   H   R   I   N   *   Y   P   R   K   E   N   D   *   K   Q   Q   Y   E
          K   I   T   G   *   I   R   I   H   G   K   K   T   I   K   S   K   N   I   N
            *   R   A   K   Y   E   L   I   A   K   K   R   *   R   V   K   T   S   I   G

22201  AATATTACAAAGAGAAAGATTCAAATTAAGAACATTTTCACTATAAAATAGTGAATTGTT  22260
         K   Y   H   K   E   K   *   T   *   N   K   Y   F   H   Y   K   I   V   *   C
          R   I   I   N   R   K   R   L   K   I   R   T   F   T   I   N   *   *   K   V
            *   L   T   E   R   E   L   N   L   E   Q   L   L   S   I   K   D   S   L   L

22261  AGGATAAAAATAATTAATAAGATTCCTTCAAATAAAATGAAATAATCCAACAAGAGAAAT  22320
         D   *   K   *   *   N   N   *   P   L   K   N   *   K   I   L   N   N   E   K
          I   R   N   K   N   I   I   R   L   F   N   I   K   S   *   *   T   T   R   K
            G   I   K   I   L   *   E   L   S   T   *   K   V   K   N   P   Q   E   R   *

22321  AAATCATGGCGAAACGGAAAAAATTTAGATTGAAATCAGTCATGATAATATTGTATCTATG  22380
         N   L   V   A   K   G   K   *   I   *   S   *   D   T   S   N   Y   C   L   Y
          I   *   Y   R   K   A   K   K   F   R   V   K   T   L   V   I   I   V   Y   I
            K   T   G   S   Q   R   K   L   D   L   K   L   *   Y   *   *   L   M   S   V

22381  ACCGAGACAAATACCAAAAAGATTACAACAAATAGGACTAAATCTGACATAAATATAAAG  22440
         Q   S   Q   K   H   N   K   *   H   Q   K   D   Q   N   L   S   Y   K   Y   K
          S   A   R   N   I   T   K   R   I   N   N   I   R   I   *   V   T   N   I   N
            P   E   T   *   P   K   E   L   T   T   *   G   S   K   S   Q   I   *   I   E

22441  AGAATTTGGTCCAAGAATATTTCAAAGGTGGTGACGTGGAAAAAATAGGAATGGATGATT  22500
         E   *   V   L   N   K   Y   L   K   W   W   Q   V   K   K   I   R   V   *   *
          R   K   F   W   T   R   I   F   N   G   G   S   C   R   K   *   G   *   R   S
            R   L   G   P   E   *   L   T   E   V   V   A   G   K   K   D   K   G   V   L

22501  TCGAGAGACAAAACTATTTAGATTTGTTAAACATGGACATGTCCAACAACTAAGATCTAC  22560
         L   E   R   N   Q   Y   I   *   V   I   Q   V   Q   V   P   Q   Q   N   *   I
          F   S   E   T   K   I   F   R   F   L   K   Y   R   Y   L   N   N   I   R   S
            A   R   Q   K   S   L   D   L   C   N   T   G   T   C   T   T   S   E   L   H

22561  CTTGTTGCTCGCACGGAGTCTATAAAGAAATAGACAACGTACAGTTAACGGTATAACAAT  22620
         S   C   R   A   H   R   L   Y   K   K   I   Q   Q   M   D   I   A   M   N   N
          P   V   V   L   T   G   *   I   N   R   *   R   N   C   T   L   Q   W   I   T
            F   L   S   R   A   E   S   I   E   K   D   T   A   H   *   N   G   Y   Q   *

22621  AAAAGCGTTAAGAAGACGATTAATACAACCGTTCATACTATAATTGGTGCCACTATCACC  22680
         N   E   C   N   K   Q   *   N   H   Q   C   T   H   Y   *   G   R   H   Y   H
          I   K   A   I   R   R   S   I   I   N   A   L   I   I   N   V   V   T   I   T
            K   R   L   E   E   A   L   *   T   P   L   Y   S   I   L   W   P   S   L   P
```

FIG. 3 CONT'D

```
22681  AAAATAAAGATAAAATAGACCAGAAAATATATTACAAAGAACATAAAGTATAATACCACA  22740
         N  *  K  *  K  I  Q  D  K  I  Y  H  K  K  Y  K  M  N  H  H
          T  K  N  R  N  *  R  T  K  *  I  I  N  R  T  N  *  I  I  T
            K  I  E  I  K  D  P  R  K  Y  L  T  E  Q  I  E  Y  *  P  T

22741  TAAAAATATACTATTAAAATGTAGGTAAACCGGGATAATAAGAAAACCATCCACAGGATG  22800
         I  K  I  H  Y  N  *  M  W  K  A  R  N  N  K  Q  Y  T  D  *
          Y  K  *  I  I  I  K  C  G  N  P  G  I  I  R  K  T  P  T  R
            N  K  Y  S  L  K  V  D  M  Q  G  *  *  E  K  P  L  H  G  V

22801  TAGAAGATAATAATTTGTAGGTTAAACACAAATACTAAAAAACGGATAATAAAATGTTCC  22860
         M  K  *  *  *  V  D  L  K  H  K  H  N  K  A  *  *  K  V  L
          C  R  R  N  N  F  M  W  N  T  N  I  I  K  Q  R  N  N  *  L
            D  E  I  I  L  C  G  I  Q  T  *  S  K  K  G  I  I  K  C  P

22861  ATAAAATAATACAAATCGAAATGAAAAACAACAAAAAGATAATAAAAACAATATATTGCT  22920
         Y  K  I  I  N  L  K  V  K  Q  Q  K  E  I  I  K  T  I  Y  R
          T  N  *  *  T  *  S  *  K  K  N  N  K  *  *  K  Q  *  I  V
            I  K  N  H  K  A  K  S  K  T  T  K  R  N  N  K  N  Y  L  S

22921  ATTTAGAGTAATTTAGATTTGTACAATAATTAATAAAAATAAAACGGATGTTGTAATCGA  22980
         Y  I  E  N  F  R  F  M  N  N  I  I  K  I  K  G  V  V  N  A
          I  F  R  M  L  D  L  C  T  I  L  *  K  *  K  A  *  L  M  L
            L  D  *  *  I  *  V  H  *  *  N  N  K  N  Q  R  C  C  *  S

22981  CAATATCCACTAAAATTAACATGATTAAAACGATAATTACTAAATTTGTGGTGTCAAGGA  23040
         T  I  P  S  K  L  Q  V  L  K  A  I  L  S  K  F  V  V  T  G
          Q  *  L  H  N  *  N  Y  *  N  Q  *  *  H  N  L  C  W  L  E
            N  Y  T  I  K  I  T  S  I  K  S  N  I  I  *  V  G  C  N  R

23041  GCGTATTCACTCATACAACACCTACAAAGAATACCAAACCCATGTATAATATATGAACTA  23100
         R  M  L  S  Y  T  T  S  T  E  *  P  K  P  V  Y  *  I  S  S
          E  C  L  H  T  H  Q  P  H  K  K  H  N  P  Y  M  N  Y  V  Q
            A  Y  T  L  I  N  H  I  N  R  I  T  Q  T  C  I  I  Y  K  I

23101  GCACAAATAAATTTATGATGATATAATAAATGACCAATAAAGGGATTTAGACCACGGTTA  23160
         R  T  *  K  F  V  V  I  N  N  V  P  *  K  G  L  D  P  A  L
          D  H  K  N  L  Y  *  *  I  I  *  Q  N  N  G  *  I  Q  H  W
            T  N  I  *  I  S  S  Y  *  K  S  T  I  E  R  F  R  T  G  I

23161  AAATCCCTAGATAGAAATTTTCCATGATGTATAAACTCATGAGAAACCATAGTCTTTGGG  23220
         K  L  S  R  D  K  F  P  V  V  Y  K  L  V  R  Q  Y  *  F  G
          N  *  P  D  I  K  L  L  Y  *  M  N  S  Y  E  K  T  D  S  V
            K  P  I  *  R  *  F  T  S  C  I  Q  T  S  K  P  I  L  F  G
```

FIG. 3 CONT'D

```
23221  AAAAATAGACTAAAATTATTACCATAAAAAAGATCTCAATTCTTATGATTCAACATACAA  23280
         K  K  D  S  K  L  L  P  I  K  E  L  T  L  F  V  L  N  Y  T
          R  K  I  Q  N  *  Y  H  Y  K  K  *  L  *  S  Y  *  T  T  H
           K  *  R  I  K  I  I  T  N  K  R  S  N  L  I  S  L  Q  I  N

23281  TTATTTTGAAACATATCACTCAAATCATGATATCAATATCCATCACAAAAATAATTGTTG  23340
         L  L  V  K  Y  L  S  N  L  V  I  T  I  P  L  T  K  I  L  L
          *  Y  F  K  T  Y  H  T  *  Y  *  L  *  L  Y  H  K  *  *  C
           I  F  S  Q  I  T  L  K  T  S  Y  N  Y  T  T  N  K  N  V  V

23341  AGAATATGATAACAACAAGTTGGAGTATTACCACAAAACCTCTAATGTCGAACAGTTATG  23400
         E  *  V  I  T  T  *  G  *  L  P  T  K  S  I  V  A  Q  *  Y
          S  K  Y  *  Q  Q  E  V  E  Y  H  H  K  P  S  *  L  K  D  I
           R  I  S  N  N  L  R  M  I  T  N  Q  L  N  C  S  T  L  V

23401  TGATACACACTCATAGGAGTATGATAAACATTTAGATTTCCATCAAGAGCATTACTTAGA  23460
         V  I  H  S  Y  G  *  V  I  Q  L  D  L  P  L  E  R  L  S  D
          C  *  T  H  T  D  E  Y  *  K  Y  I  *  L  Y  N  E  Y  H  I
           S  H  T  L  I  R  M  S  N  T  F  R  F  T  T  R  T  I  F  R

23461  ACCGTAAAACTATTTAGACTTGGAAACACAGACAAGTTCTTTTTAAAATGAATATTACAA  23520
         Q  C  K  S  L  D  S  G  K  H  R  N  L  F  F  K  V  *  L  T
          K  A  N  Q  Y  I  Q  V  K  T  D  T  *  S  F  N  *  K  Y  H
           P  M  K  I  F  R  F  R  Q  T  Q  E  L  F  I  K  S  I  I  N

23521  AGATGTCTAACCAACATAAAAGTAAAAATAGTTCTTGCACCGTGAAAAATACGAATAATA  23580
         E  V  S  Q  N  Y  K  *  K  *  *  S  R  P  V  K  *  A  *  *
          K  *  L  N  T  T  N  E  N  K  D  L  V  H  C  K  K  H  K  N
           R  C  I  P  Q  I  K  M  K  I  L  F  T  A  S  K  I  S  I  I

23581  CGACTAAGACCGTACGGATGATGAAAAAATAAATCAAACATAGAACCATGAGAAAATAGA  23640
         A  S  E  P  M  G  V  V  K  K  N  L  K  Y  R  P  V  R  K  D
          H  Q  N  Q  C  A  *  *  K  K  I  *  N  T  D  Q  Y  E  K  I
           S  I  R  A  H  R  S  S  K  *  K  T  Q  I  K  T  S  K  *  R

23641  GTAATAATACAAAACGGAAACTGAACATTACGATATAGAAGATTATGACTATTACTCTGA  23700
         *  *  *  T  K  G  K  V  Q  L  A  I  D  E  L  V  S  L  S  V
          E  N  N  H  K  A  K  S  K  Y  H  *  I  K  *  Y  Q  Y  H  S
           M  I  I  N  Q  R  Q  S  T  I  S  Y  R  R  I  S  I  I  L  S

23701  AATGTTATAACCCAGTGTGGAAACAGATTTGCGGTTATAGAAGAATTTAAACTGTTGGCA  23760
         K  C  Y  Q  T  V  G  K  D  L  R  W  Y  R  R  L  N  S  L  R
          K  V  I  N  P  *  V  K  T  *  V  G  I  D  E  *  I  Q  C  G
           *  L  I  P  D  C  R  Q  R  F  A  L  I  K  K  F  K  V  V  T
```

FIG. 3 CONT'D

```
23761  CCACAATAATGATTACGACAACTAACAAGATCATCAAAGAAATCGCTCTAAGTTACATTT  23820
          P  T  I  V  L  A  T  S  Q  E  L  L  K  K  L  S  I  *  H  L
        H  H  *  *  *  H  Q  Q  N  N  *  Y  N  R  *  R  S  E  I  Y
           T  N  N  S  I  S  N  I  T  R  T  T  E  K  A  L  N  L  T  F

23821  TGATTTAGAAATAATGGATTATGACCACAAATACTGAATAGACCAAAATGACAATTCGGA  23880
          V  L  D  K  N  G  L  V  P  T  *  S  K  D  P  K  V  T  L  G
        F  *  I  K  I  V  *  Y  Q  H  K  H  S  I  Q  N  *  Q  *  A
           S  F  R  *  *  R  I  S  T  N  I  V  *  R  T  K  S  N  L  R

23881  CAACGTTGACATGTAGCAGCATAAGGACTAAATGGACTAACACTGTAACTATTTACCGAA  23940
          T  A  V  T  C  R  R  I  G  S  K  G  S  Q  S  M  S  L  H  S
        Q  Q  L  Q  V  D  D  Y  E  Q  N  V  Q  N  H  C  Q  Y  I  A
           N  C  S  Y  M  T  T  N  R  I  *  R  I  T  V  N  I  F  P  K

23941  TTGTTAAAATTACATGGGAGTGGAGAATTAACCCTTGCATTTTAAAAAAGATTAACGTTG  24000
          L  L  K  L  T  G  E  G  R  L  Q  S  R  L  I  K  E  L  Q  L
        *  C  N  *  H  V  R  V  E  *  N  P  V  Y  F  K  K  *  N  C
           V  I  K  I  Y  G  *  R  K  I  P  F  T  F  N  K  R  I  A  V

24001  AAATTAAACTCATGAAACGAAGCAAATCAAGTATGACTAAGAAAAAGAACATTATTAAAA  24060
          K  L  K  L  V  K  S  R  K  T  *  V  S  E  K  E  Q  L  L  K
        S  *  N  S  Y  K  A  E  N  L  E  Y  Q  N  K  K  K  Y  Y  N
           K  I  Q  T  S  Q  K  T  *  N  M  S  I  R  K  R  T  I  I  K

24061  CTACTTAGATTCTATATACCATCAACAAAATTCTCATAACAAAATCTATTTAAACGGTAT  24120
          S  S  D  L  I  Y  P  L  Q  K  L  L  I  T  K  S  L  N  A  M
        Q  H  I  *  S  I  H  Y  N  N  *  S  Y  Q  K  L  Y  I  Q  W
           I  F  R  L  Y  I  T  T  T  K  L  T  N  N  *  I  F  K  G  Y

24121  GGGTTGAGGTCTGCTAGACTAAACGTCAACCCGTCAAGACCAAAAGACGTTAGAAGATTA  24180
          G  L  E  L  R  D  S  K  C  N  P  L  E  P  K  R  C  D  E  L
        V  W  S  W  V  I  Q  N  A  T  P  C  N  Q  N  E  A  I  K  *
           G  V  G  S  S  R  I  Q  L  Q  A  T  R  T  K  Q  L  R  R  I

24181  ATATTTTAACTGTGATGAAGATCAAGAACAGTTAACATAATATCAAACGGACGTTAATTA  24240
          *  L  I  S  V  V  E  L  E  Q  *  N  Y  *  L  K  G  A  I  L
        N  Y  F  Q  C  *  K  *  N  K  D  I  T  N  Y  N  A  Q  L  *
           I  F  N  V  S  S  R  T  R  T  L  Q  I  I  T  Q  R  C  N  I

24241  CAATGATAATTATTAATATTAGGAAGAAGAACCTTATCTTCCATACCAAAATTATTAAAA  24300
          T  V  I  L  L  *  L  G  E  E  Q  F  L  L  Y  P  K  L  L  K
        H  *  *  *  Y  N  Y  D  K  K  K  S  Y  F  T  H  N  *  Y  N
           N  S  N  I  I  I  I  R  R  R  P  I  S  P  I  T  K  I  I  K
```

FIG. 3 CONT'D

```
24301  TTAAACTCGAGAGTATCACAACAAATGAGTGCAATAACAAAAAGACAATTATTATGAAAA  24360
          L  K  L  E  *  L  T  T  *  E  R  *  Q  K  E  T  L  L  V  K
           *  N  S  S  E  Y  H  Q  K  S  V  N  N  N  K  Q  *  Y  Y  K
             I  Q  A  R  M  T  N  N  V  *  T  I  T  K  R  N  I  I  S  K

24361  ACAGGAACACGATTTGGAAGAAAACGAAGTTCAACGTTCTCAGTATTTGGTGGAAGACGA  24420
          Q  G  Q  A  L  G  E  K  A  E  L  Q  L  L  *  L  G  G  E  A
           K  D  K  H  *  V  K  K  Q  K  L  N  C  S  D  Y  V  V  K  Q
             T  R  T  S  F  R  R  K  S  *  T  A  L  T  M  F  W  R  R  S

24421  AGGACAGGATAACCATGATTAATAGCAAGAACACTCTCATGATGACATGAGCTGGTGTGA  24480
          E  Q  G  I  P  V  L  *  R  E  Q  S  L  V  V  T  S  S  W  V
           K  R  D  *  Q  Y  *  N  D  N  K  H  S  Y  *  Q  V  R  G  C
             G  T  R  N  T  S  I  I  T  R  T  L  T  S  S  Y  E  V  V  S

24481  CTGACCACATCCACAAGAACAAATGGACTAGGATATTGACGAATACTGGGATCCAGAACA  24540
          S  Q  H  L  H  E  Q  K  G  S  G  I  V  A  *  S  G  L  D  Q
           Q  S  T  Y  T  N  K  N  V  Q  D  *  L  Q  K  H  G  *  T  K
             V  P  T  P  T  R  T  *  R  I  R  Y  S  S  I  V  R  P  R  T

24541  AGAGTTTTTTTCAGAGACCAACCACAACCACTTGTAACACGTCCCAAGCCACAACTACTT  24600
          E  *  F  F  D  R  T  P  T  P  S  C  Q  A  P  N  P  T  S  S
           N  E  F  F  T  E  P  Q  H  Q  H  V  N  H  L  T  R  H  Q  H
             R  L  F  L  R  Q  N  T  N  T  F  M  T  C  P  E  T  N  I  F

24601  CTTTTCACACCACATAACCTACCTAGTATATTACAAAGAACAGAAACATCATGACTACGG  24660
          S  F  H  P  T  N  S  P  D  Y  L  T  E  Q  R  Q  L  V  S  A
           L  F  T  H  H  I  P  H  I  M  Y  H  K  K  D  K  Y  Y  Q  H
             F  L  T  T  Y  Q  I  S  *  I  I  N  R  T  K  T  T  S  I  G

24661  AAAGATCCAACCAGAATACTGTGAACGCAGTCATTGTTGGCAACATTATAAAAAGATTA   24720
          K  R  P  Q  D  *  S  V  Q  T  L  L  L  R  Q  L  I  K  E  L
           R  E  L  N  T  K  H  C  K  R  *  Y  C  G  N  Y  Y  K  K  *
             K  *  T  P  R  I  V  S  A  D  T  V  V  T  T  I  N  K  R  I

24721  AAATAAAATTTACCATAGTTATCACCATGGTGAACAAGATTACTAAATAACGTCGGATTA  24780
          K  I  K  F  P  I  L  L  P  V  V  Q  E  L  S  K  N  C  G  L
           N  *  K  L  H  Y  *  Y  H  Y  W  K  N  *  H  N  I  A  A  *
             K  N  *  I  T  D  I  T  T  G  S  T  R  I  I  *  Q  L  R  I

24781  TGACTTCAAAAATGACTACAAACACAACTAATGCTGGAAATACCATAATGTCCTGTTCCA  24840
          V  S  T  K  V  S  T  Q  T  S  *  S  R  *  P  I  V  P  C  P
           Y  Q  L  K  *  Q  H  K  H  Q  N  R  G  K  H  Y  *  L  V  L
             S  F  N  K  S  I  N  T  N  I  V  V  K  I  T  N  C  S  L  T
```

FIG. 3 CONT'D

```
24841  TAAAAATTTCTTCAAAGACGACAAATAATATTATCAACCGTTTTAGAAAACATACTAAGA  24900
          I  K  L  S  T  E  A  T  *  *  L  L  Q  C  F  R  K  Y  S  E
         Y  K  *  L  L  K  Q  Q  K  N  Y  Y  N  A  F  D  K  T  H  N
            N  K  F  F  N  R  S  N  I  I  I  T  P  L  I  K  Q  I  I  R

24901  TTACCGTTGTAATAACCAAAATTTCTAAAACAATGATTATTTTGTATATTATAAAAGGGA  24960
          L  P  L  M  I  P  K  L  S  K  T  V  L  L  V  Y  L  I  K  G
         *  H  C  C  *  Q  N  *  L  N  Q  *  *  Y  F  M  Y  Y  K  G
            I  A  V  N  N  T  K  F  I  K  N  S  I  F  C  I  I  N  E  R

24961  ACAATACGTCCTTCTCAAAGACGACGAAAAGTAGTTTTACGAAGGAGAAACCGAAATGAA  25020
          Q  *  A  P  L  T  E  A  A  K  *  *  F  A  E  E  K  A  K  S
         K  N  H  L  F  L  K  Q  Q  K  E  D  F  H  K  R  K  P  K  V
            T  I  C  S  S  N  R  S  S  K  M  L  I  S  G  R  Q  S  *  K

25021  ATAGCATTAAATTTTACATCGATACAAAACTTATTATAAAGAAATTGATGAGTCGGTATA  25080
          *  R  L  K  F  H  L  *  T  K  F  L  I  E  K  V  V  *  G  Y
         K  D  Y  N  L  I  Y  S  H  K  S  Y  Y  K  K  L  *  E  A  M
            I  T  I  *  F  T  A  I  N  Q  I  I  N  R  *  S  S  L  W  I

25081  AAACTATCAATAGAACCAACGCAAAAATTACGACTATTAAATTGACTAATAAGACAAAGA  25140
          K  S  L  *  R  P  Q  T  K  L  A  S  L  K  V  S  *  E  T  E
         N  Q  Y  N  D  Q  N  R  K  *  H  Q  Y  N  L  Q  N  N  Q  K
            K  I  T  I  K  T  A  N  K  I  S  I  I  *  S  I  I  R  N  R

25141  AGAACACGAGAAGCGTACCCATCACCAAAAACACAACTAATATTGAGTGGAAGAAGAAGG  25200
          E  Q  A  R  R  M  P  L  P  K  Q  T  S  *  L  E  G  E  E  E
         K  K  H  E  E  C  P  Y  H  N  K  H  Q  N  Y  S  V  K  K  K
            R  T  S  K  A  H  T  T  T  K  T  N  I  I  V  *  R  R  R  G

25201  AGAAGCGCAGCATTTGCATCTTCATAAAGACGAAGAATAGCAAAACAATGAAAACTTGGG  25260
          E  E  R  R  L  R  L  L  I  E  A  E  *  R  K  T  V  K  S  G
         R  K  A  D  Y  V  V  F  Y  K  Q  K  K  D  N  Q  *  K  Q  V
            R  R  T  T  F  T  S  T  N  R  S  R  I  T  K  N  S  K  F  G

25261  AAATTACAGTCAAAACAATTACTGTCATAACTCAGACACCCACCAGAAATACTCTAGTTT  25320
          K  L  T  L  K  T  L  S  L  I  S  D  T  P  P  R  *  S  I  L
         R  *  H  *  N  Q  *  H  C  Y  Q  T  Q  P  H  D  K  H  S  *
            K  I  D  T  K  N  I  V  T  N  L  R  H  T  T  K  I  L  D  F

25321  TAAGGGTGATTGAAATGATATCAACCAGTTCTCCTTAAATAAGTTTGATTAAGAGGATTT  25380
          I  G  V  L  K  V  I  T  P  *  S  S  N  I  *  V  L  E  G  L
         F  E  W  *  S  *  *  L  Q  D  L  P  I  *  E  F  *  N  E  *
            N  G  S  V  K  S  Y  N  T  L  L  F  K  N  L  S  I  R  R  F
```

FIG. 3 CONT'D

```
25381  CAATGATAACTAACAAGAAATAAACAGACAAGATTAATACGTCGAACGGTACTGAATAAC  25440
          T  V  I  S  Q  E  K  N  T  Q  E  L  *  A  A  Q  W  S  K  N
         L  *  *  Q  N  N  K  I  Q  R  N  *  N  H  L  K  G  H  S  I
            N  S  N  I  T  R  *  K  D  T  R  I  I  C  S  A  M  V  *  Q

25441  AGTCTCATACCGTGAAAAACACTATTATAATTATCATAAAATCTACTTCAATTACCAAAT  25500
          D  S  Y  P  V  K  Q  S  L  I  L  L  I  K  S  S  T  L  P  K
         T  L  T  H  C  K  K  H  Y  Y  *  Y  Y  K  L  H  L  *  H  N
            *  L  I  A  S  K  T  I  I  N  I  T  N  *  I  F  N  I  T  *

25501  GAACTATGATGAGTTAACGTACATCGACTATGAGAATACGTTCCACAGTGTGAATCGAGG  25560
          S  S  V  V  *  N  C  T  A  S  V  R  I  C  P  T  V  S  L  E
         V  Q  Y  *  E  I  A  H  L  Q  Y  E  *  A  L  H  *  V  *  S
            K  I  S  S  L  Q  M  Y  S  I  S  K  H  L  T  D  C  K  A  G

25561  TTAGAATTATGATTAAACGTAAAACTACAACTATTATAATTAAAATTTAGGGATCAACCT  25620
          L  R  L  V  L  K  C  K  S  T  S  L  I  L  K  L  D  R  T  P
         W  D  *  Y  *  N  A  N  Q  H  Q  Y  Y  *  N  *  I  G  L  Q
            I  K  I  S  I  Q  M  K  I  N  I  I  N  I  K  F  G  *  N  S

25621  ACAAATCCAGGTGTGACGCCAAGAAGAAGAGCAAGAAAAAAACTTCTAAATAACAAACTG  25680
          H  K  P  G  C  Q  P  E  E  E  R  E  K  K  S  S  K  N  N  S
         I  N  L  D  V  S  R  N  K  K  E  N  K  K  Q  L  N  I  T  Q
            T  *  T  W  V  A  T  R  R  R  T  R  K  K  F  I  *  Q  K  V

25681  TTTCAATTTGAAAGTCTACAACCAAAACAACTTCGAATATTGTTAACATGACCACCATCA  25740
          L  T  L  S  E  S  T  P  K  T  S  A  *  L  L  Q  V  P  P  L
         C  L  *  V  K  L  H  Q  N  Q  Q  L  K  Y  C  N  Y  Q  H  Y
            F  N  F  K  *  I  N  T  K  N  F  S  I  V  I  T  S  T  T  T

25741  CTTTAATCTCTAGAAGAAACACATGTTAGGAAATTACCATAATTTCAAAACGGAGGATAA  25800
          S  I  L  S  R  R  Q  T  C  D  K  L  P  I  L  T  K  G  G  I
         H  F  *  L  D  E  K  H  V  I  R  *  H  Y  *  L  K  A  E  *
            F  N  S  I  K  K  T  Y  L  G  K  I  T  N  F  N  Q  R  R  N

25801  AACAGACTTAGAGTTTAAAGACCAATGTGGTGTCGGCGATGACAACGACGATACAAAGGT  25860
          K  D  S  D  *  I  E  P  *  V  V  A  A  V  T  A  A  I  N  G
         K  T  Q  I  E  F  K  Q  N  C  W  L  R  *  Q  Q  Q  *  T  E
            Q  R  F  R  L  N  R  T  V  G  C  G  S  S  N  S  S  H  K  W

25861  GGTACCAGTCGTCGTCGACCGTATGGTAAAAGAGAATTACATGTTATATCTTAATTACCA  25920
          G  H  D  A  A  A  P  M  G  N  E  R  L  T  C  Y  L  I  L  P
         V  M  T  L  L  L  Q  C  V  M  K  E  *  H  V  I  Y  F  *  H
            W  P  *  C  C  S  A  Y  W  K  R  K  I  Y  L  I  S  N  I  T
```

FIG. 3 CONT'D

```
25921  AACCCACAATGATACCTACAAGAATTATTTTTAGTTTTCAACTATCGATGACGAAAATTA  25980
         K  P  T  V  I  S  T  R  L  L  F  *  F  N  I  A  V  A  K  L
        N  P  H  *  *  P  H  E  *  Y  F  D  F  T  S  L  *  Q  K  *
          Q  T  N  S  H  I  N  K  I  F  I  L  L  Q  Y  S  S  S  K  I

25981  TTACGAGAAGAAAGATAAGTCTTACCAAAATCACGATGGTTGAGACGTGAACGATTTTAT  26040
         L  A  R  R  E  I  *  F  P  K  L  A  V  L  E  A  S  A  L  I
        Y  H  E  E  K  *  E  S  H  N  *  H  *  W  S  Q  V  Q  *  F
          I  S  K  K  R  N  L  I  T  K  T  S  G  V  R  C  K  S  F  Y

26041  GTTTCACAACAATTAAGATTACGAGTTCGTGAATTATCAAACAATGTCGTTAATAAATTA  26100
         C  L  T  T  L  E  L  A  *  A  S  L  L  K  N  C  C  N  N  L
        V  F  H  Q  *  N  *  H  E  L  V  *  Y  N  T  V  A  I  I  *
          L  T  N  N  I  R  I  S  L  C  K  I  T  Q  *  L  L  *  K  I

26101  TTTAAACCACGTTAATCAAGAAGAAATGTTCTTTAAAATAGAGCAGAGCTACGAAATCTC  26160
         L  N  P  A  I  L  E  E  K  C  S  I  K  D  R  R  S  A  K  S
        Y  I  Q  H  L  *  N  K  K  V  L  F  K  I  E  D  R  H  K  L
          F  K  T  C  N  T  R  R  *  L  F  N  *  R  T  E  I  S  *  L

26161  CGAGTCCAAGTCTAACTATCCGAATAATTACCAGCAAATTGACGAAATTTACGAATACAG  26220
         A  *  T  *  I  S  L  S  I  L  P  R  K  V  A  K  F  A  *  T
        P  E  P  E  S  Q  Y  A  *  *  H  D  N  L  Q  K  L  H  K  H
          S  L  N  L  N  I  P  K  N  I  T  T  *  S  S  *  I  S  I  D

26221  AGAGTTGTCGAATCACTATAAAGAGAACATTTTAAACCACGACGAAATCGATACCTCTTC  26280
         E  *  C  S  L  S  I  E  R  T  F  N  P  A  A  K  A  I  S  F
        R  E  V  A  *  H  Y  K  E  Q  L  I  Q  H  Q  K  L  *  P  S
          R  L  L  K  T  I  N  R  K  Y  F  K  T  S  S  *  S  H  L  L

26281  CAATTACTCACACAATTTTCAGTTAGAGGAGCATAATTAAAAACACCATTACCATTAGTA  26340
         T  L  S  H  T  L  L  *  D  G  R  I  L  K  Q  P  L  P  L  *
        P  *  H  T  H  *  F  D  I  E  E  Y  *  N  K  H  Y  H  Y  D
          N  I  L  T  N  F  T  L  R  R  T  N  I  K  T  T  I  T  I  M

26341  TAAAACAGTAATCAAGTTTTACGAGGAATACCAAACAACAAATACGTAAAATCAATATTT  26400
         I  K  D  N  T  *  F  A  G  *  P  K  N  N  I  C  K  L  *  L
        Y  K  T  M  L  E  F  H  E  K  H  N  T  T  *  A  N  *  N  Y
          N  Q  *  *  N  L  I  S  R  I  T  Q  Q  K  H  M  K  T  I  F

26401  GGATAAAGAAAATTTTGACAAAATCATTCAGGACCAAACACATATAGTCCACTACATCCA  26460
         G  I  E  K  L  V  T  K  T  L  G  P  K  H  I  D  P  S  T  P
        V  *  K  K  *  F  Q  K  L  L  D  Q  N  T  Y  I  L  H  H  L
          R  N  R  K  F  S  N  *  Y  T  R  T  Q  T  Y  *  T  I  Y  T
```

FIG. 3 CONT'D

```
26461  TAACGTGGATTTGTTCCCATAAAATAATTTGTATTACTAGTAACCTACAAGTGACCATCA  26520
         I  A  G  L  C  P  Y  K  I  L  C  L  S  *  Q  I  N  V  P  L
        Y  Q  V  *  V  L  T  N  *  *  V  Y  H  D  N  S  T  *  Q  Y
          N  C  R  F  L  P  I  K  N  F  M  I  I  M  P  H  E  S  T  T

26521  AGAATGATAATAGGACTTGGTTAAAGTCTATTTTTACAACAAAAATACTTATGAACAAGA  26580
         E  *  *  *  G  S  G  I  E  S  L  F  T  T  K  I  F  V  Q  E
        N  K  S  N  D  Q  V  L  K  L  Y  F  H  Q  K  *  S  Y  K  N
          R  V  I  I  R  F  W  N  *  I  F  I  N  N  K  H  I  S  T  R

26581  CAATTAAAATGATTTCGCGGAGAACAAATAAACTTAGTAAGACATGGTTTTAACAGACTA  26640
         T  L  K  V  L  A  G  R  T  *  K  F  *  E  T  G  F  N  D  S
        Q  *  N  *  *  L  A  E  Q  K  N  S  D  N  Q  V  L  I  T  Q
          N  I  K  S  F  R  R  K  N  I  Q  I  M  R  Y  W  F  Q  R  I

26641  AAACTTAGACTCAATAGAGTAACCAAATTTTTAGTTTGTAGGTAACGCGGATTAAACTGA  26700
         K  S  D  S  N  D  *  Q  N  L  F  *  V  D  M  A  G  L  K  V
        N  Q  I  Q  T  I  E  N  T  *  F  D  F  M  W  Q  A  *  N  S
          K  F  R  L  *  R  M  P  K  F  I  L  C  G  N  R  R  I  Q  S

26701  AATTTAGAAGTATGATAATTACGATGAAAAAATCTAAACATAATACTCTACTTAGAATAA  26760
         K  F  R  *  V  I  L  A  V  K  K  S  K  Y  *  S  I  F  R  I
        K  L  D  E  Y  *  *  H  *  K  K  L  N  T  N  H  S  S  D  *
          *  I  K  M  S  N  I  S  S  K  *  I  Q  I  I  L  H  I  K  N

26761  GTTCTCAGATAATTCAGAAACTTATTATCAATATAGTTAGAATTTCTATATCCATGTATA  26820
         *  S  D  I  L  D  K  F  L  L  *  I  L  R  L  S  I  P  V  Y
        E  L  T  *  *  T  K  S  Y  Y  N  Y  *  D  *  L  Y  L  Y  M
          L  L  R  N  L  R  Q  I  I  T  I  D  I  K  F  I  Y  T  C  I

26821  CTTTACATACATTTTACCGGAACCATACAAACCGATGATTAAAGAAAAAGTAAATATTAT  26880
         S  I  Y  T  F  H  G  Q  Y  T  Q  S  S  I  E  K  E  N  I  I
        H  F  T  H  L  I  A  K  T  H  K  A  V  L  K  K  K  M  *  L
          F  H  I  Y  F  P  R  P  I  N  P  *  *  N  R  K  *  K  Y  Y

26881  AAGGAACATAACGAGAAAAAATATACAACAACATGACCAACACCAAGACGTACAAAATCA  26940
         N  R  T  N  S  K  K  I  H  Q  Q  V  P  Q  P  E  A  H  K  L
        I  G  Q  I  A  R  K  *  I  N  N  Y  Q  N  H  N  Q  M  N  *
          E  K  Y  Q  E  K  K  Y  T  T  T  S  T  T  T  R  C  T  K  T

26941  TTTACAGTATTAACAACACTACTCATACCACCAGTAGTACTAAAACAATAGTTTTGTAGA  27000
         L  H  *  L  Q  Q  S  S  Y  P  P  *  *  S  K  T  I  L  V  D
        Y  I  D  Y  N  N  H  H  T  H  H  D  D  H  N  Q  *  *  F  M
          F  T  M  I  T  T  T  I  L  I  T  T  M  M  I  K  N  D  F  C  R
```

FIG. 3 CONT'D

```
27001  GTACTACTAATCTTAGAGAACAGTCTAGAGTAATTTAGATTTGAAATAAATACCTGCAAA  27060
         *  S  S  *  F  R  K  D  S  R  M  L  D  L  S  *  K  H  V  N
           E  H  H  N  S  D  R  T  L  D  *  *  I  *  V  K  N  I  S  T
             M  I  I  L  I  E  Q  *  I  E  N  F  R  F  K  I  *  P  R  K

27061  CCTCTGGATCGATGTGTGTAAGAGAACAATAATCTCTTAAACCACAATGTTTGGAACTTC  27120
         P  S  R  A  V  C  M  R  K  N  N  S  F  K  T  N  C  V  K  F
           Q  L  G  L  *  V  C  E  R  T  I  L  S  N  P  T  V  F  R  S
             S  V  *  S  C  V  N  E  Q  *  *  L  I  Q  H  *  L  G  Q  L

27121  TAAACACAGATTTCATATTAATGACAGTTGGATAACAACCAATGACATAACATGGAAATT  27180
         I  Q  T  *  L  I  I  V  T  L  R  N  N  T  V  T  N  Y  R  *
           S  K  H  R  F  Y  L  *  Q  *  G  I  T  P  *  Q  I  T  G  K
             N  T  D  L  T  Y  N  S  D  V  *  Q  Q  N  S  Y  Q  V  K  L

27181  TACAAACCACAGCGTTCAAACCGTTTAAACGAAGAGTGAAATGTAATGCATCAGTGCTAT  27240
         I  N  P  T  A  L  K  A  F  K  S  R  V  K  C  *  T  T  V  I
           F  T  Q  H  R  L  N  P  L  N  A  E  *  K  V  N  R  L  *  S
             H  K  T  D  C  T  Q  C  I  Q  K  E  S  *  M  V  Y  D  R  Y

27241  AAAGGGTATCATTATTAAAACCACAACATTGATCAAAATGATGAATACCATTATGACAAA  27300
         N  G  M  T  I  I  K  T  N  Y  S  T  K  S  S  I  T  I  S  N
           I  E  W  L  L  L  K  P  T  T  V  L  K  V  V  *  P  L  V  T
             K  G  Y  Y  Y  N  Q  H  Q  L  *  N  *  *  K  H  Y  Y  Q  K

27301  GACTCCGACACAGATCTAATCAACTTAGTCGAAGACTTAAATAACAAACCGCACGTCTCC  27360
         R  L  S  H  R  S  *  N  F  *  S  R  F  K  N  N  P  T  C  L
           E  S  A  T  D  L  N  T  S  D  A  E  S  N  I  T  Q  R  A  S
             Q  P  Q  T  *  I  L  Q  I  L  K  Q  I  *  Q  K  A  H  L  P

27361  GTGAATTATTCATACCAACTAAATAAAAAGTTACTATGACGAACCATGTATCCTGTCTAA  27420
         C  K  I  L  I  T  S  K  N  K  L  S  V  A  Q  Y  M  P  C  I
           A  S  L  L  Y  P  Q  N  I  K  *  H  Y  Q  K  T  C  L  V  S
             V  *  Y  T  H  N  I  *  K  E  I  I  S  S  P  V  Y  S  L  N

27421  AATCAAAATCAAAATAAAACAGAATAAAGAAATTAGAAACAACAACGAAAAAATCGTTGA  27480
         K  T  K  T  K  N  Q  R  I  E  K  I  K  T  T  A  K  K  A  V
           K  L  K  L  K  I  K  D  *  K  K  L  R  Q  Q  Q  K  K  L  L
             *  N  *  N  *  K  T  K  N  R  *  D  K  N  N  S  K  *  C  S

27481  TAATTCGAAACATACGTTGAAACACCAAAAACATTAAAGAAATAATAAAGTGGAAGCCGA  27540
         I  L  S  Q  I  C  S  Q  P  K  Q  L  K  K  I  I  E  G  E  A
           *  *  A  K  Y  A  V  K  H  N  K  Y  N  R  *  *  K  V  K  P
             N  L  K  T  H  L  K  T  T  K  T  I  E  K  N  N  *  R  R  S
```

FIG. 3 CONT'D

```
27541  ATGCAAATATTTTCTCCATACGTCAACATATTCAGAATATCACTTGTTCAATATGGTGGG  27600
          *  T  *  L  L  P  I  C  N  Y  L  D  *  L  S  C  T  I  G  G
         K  R  K  Y  F  L  Y  A  T  T  Y  T  K  Y  H  V  L  *  V  V
            V  N  I  F  S  T  H  L  Q  I  L  R  I  T  F  L  N  Y  W  G

27601  TGAAGTCTAATAAATTAGATTTAGATTTGTAATACTTATTTAGAAAAGAAGGAGTTAAAT  27660
          V  E  S  *  K  I  *  I  *  V  N  H  I  F  R  K  K  R  L  K
         W  K  L  N  N  L  R  F  R  F  M  I  F  L  D  K  R  G  *  N
            S  *  I  I  *  D  L  D  L  C  *  S  Y  I  K  E  E  I  *

27661  GAAGACTAGTTCGACAATGTAAGAATTTTCTTACCTTAAAGAGAAACCCACATTATGATG  27720
          S  R  I  L  S  N  C  E  *  F  F  P  I  E  R  Q  T  Y  Y  *
         V  E  S  *  A  T  V  N  K  F  S  H  F  K  E  K  P  T  I  S
            K  Q  D  L  Q  *  M  R  L  L  I  S  N  R  K  P  H  L  V  V

27721  AAAAATAATGATAGTATAACGTCAAGCCAATATGCTCGGCATCATACAAACAAATAGAAT  27780
          K  K  N  S  D  Y  Q  L  E  T  I  R  A  T  T  H  K  N  I  K
         S  K  I  V  I  M  N  C  N  P  *  V  L  R  L  I  N  T  *  R
            K  *  *  *  *  I  A  T  R  N  Y  S  G  Y  Y  T  Q  K  D  *

27781  AGTTCTACTAATAAGAAACCGAATACACCGGTAACTGATAGTGGAACTGATATAAATTAA  27840
          D  L  H  N  N  K  P  K  H  P  W  Q  S  D  G  Q  S  Y  K  I
         I  L  I  I  I  R  Q  S  I  H  G  N  V  I  V  K  V  I  N  L
            *  S  S  *  E  K  A  *  T  A  M  S  *  *  R  S  *  I  *  N

27841  CAAAAATACGAAACTTATTACGAAAAGAACGTAAAAGATATCACAAATGATAATAAAGAT  27900
          T  K  I  S  Q  I  I  S  K  K  C  K  R  Y  H  K  S  N  N  R
         Q  K  *  A  K  F  L  A  K  R  A  N  E  I  T  N  V  I  I  E
            N  K  H  K  S  Y  H  K  E  Q  M  K  *  L  T  *  *  *  K  *

27901  AACAATATACCTAAGAAATAAAACAATTATCATAAGCCGAAAAATAATCTTGACCGTCAA  27960
          N  N  Y  P  N  K  I  K  N  I  T  N  P  K  K  N  S  S  A  T
         I  T  I  H  I  R  *  K  T  L  L  I  R  S  K  I  L  V  P  L
            Q  *  I  S  E  K  N  Q  *  Y  Y  E  A  K  *  *  F  Q  C  N

27961  CCACCTCAAAATTAGGTCTCTGGTTATTAGAATACACATAACTATACTTTCCGTTCTACA  28020
          P  P  T  K  I  W  L  G  I  I  K  H  T  N  I  H  F  A  L  H
         Q  H  L  K  L  G  S  V  L  L  R  I  H  I  S  I  F  P  L  I
            T  S  N  *  D  L  S  W  Y  D  *  T  Y  Q  Y  S  L  C  S  T

28021  AACAATCCGGTCAATAACTCCTGATAGTGTGTAATTGACGATGACAATAAGCACCAGTAG  28080
          K  N  P  W  N  N  L  V  I  V  C  *  S  S  S  N  N  T  T  M
         N  T  L  G  T  I  S  S  *  *  V  N  V  A  V  T  I  R  P  *
            Q  *  A  L  *  Q  P  S  D  C  M  L  Q  *  Q  *  E  H  D  D
```

FIG. 3 CONT'D

```
28081  AAATATATGTCCCACAGTTTGAACCGTGACCAATATGAGAAAGTCTAAACGGGCATATAC  28140
         K  I  Y  L  T  D  F  K  A  S  T  I  S  K  *  I  Q  G  Y  I
        R  *  I  C  P  T  L  S  P  V  P  *  V  R  E  S  K  G  T  Y
          K  Y  V  P  H  *  V  Q  C  Q  N  Y  E  K  L  N  A  R  I  H

28141  AATGACATCGATTCCACGTTCATGAAACATGGATATTTGCACGGAAAAATCTATTCAATC  28200
         N  S  Y  S  L  H  Y  K  T  G  I  F  T  G  K  *  I  L  *
        T  V  T  A  L  T  C  T  S  Q  V  *  L  R  A  K  K  S  L  N
          *  Q  L  *  P  A  L  V  K  Y  R  Y  V  H  R  K  L  Y  T  L

28201  TACAATTATCACCAAAACGACAAAAACAATTCAGATTTCAACCATTGATAGCAAATGGCA  28260
         I  N  I  T  T  K  S  N  K  N  L  R  F  N  T  V  I  T  *  R
        S  T  L  L  P  K  A  T  K  T  L  D  L  T  P  L  *  R  K  G
          H  *  Y  H  N  Q  Q  K  Q  *  T  *  L  Q  Y  S  D  N  V  T

28261  GATCATTTGGATCACCATACCTATGACGGAACAATTCTCGAATTTAGATTTGATAATCCT  28320
         R  T  F  R  T  T  H  I  S  G  Q  *  S  S  L  D  L  S  N  P
        D  L  L  G  L  P  I  S  V  A  K  N  L  A  *  I  *  V  I  L
          *  Y  V  *  H  Y  P  Y  Q  R  T  L  L  K  F  R  F  *  *  S

28321  ACAGAATATGAGGGCCAGTAATACGACCTTCATCTTCGAGGAGACCTTTAGCAAGTCCTT  28380
         H  R  I  S  G  T  M  I  S  S  T  S  A  G  R  S  I  T  *  S
        I  D  *  V  G  P  *  *  A  P  L  L  L  E  E  P  F  R  E  P
          T  K  Y  E  R  D  N  H  Q  F  Y  F  S  R  Q  F  D  N  L  F

28381  AGGAGTTCTTTTGAAGAACCCGACTGGTTAGACTCGCTTTAATGGTTTGGAAATTATCTC  28440
         D  E  L  F  S  R  P  S  V  L  R  L  S  I  V  L  G  K  I  S
        I  R  L  F  V  E  Q  A  S  W  D  S  R  F  *  W  V  K  L  L
          G  *  S  F  K  K  P  Q  G  I  Q  A  F  N  G  F  R  *  Y  L

28441  CGTCTTTTTGGGTTGGATTTAAGTGACACAGATGAGTTGGTGTTCCTTTATGATAGGGTG  28500
         A  S  F  G  L  R  F  E  S  H  R  S  L  W  L  S  I  S  D  W
        P  L  F  V  W  G  L  N  V  T  D  V  *  G  C  P  F  V  I  G
          C  F  F  G  V  *  I  *  Q  T  *  E  V  V  L  F  Y  *  G  V

28501  TAATAAGGACCAAGAGGCCCTAGTGAGTTAAAGTTTTTCCATCTCTGAAATTTAAAAGTC  28560
         M  I  G  P  E  G  P  D  S  L  K  L  F  T  S  V  K  F  K  *
        C  *  E  Q  N  E  P  I  V  *  N  *  F  P  L  S  K  L  N  E
          N  N  R  T  R  R  S  *  E  I  E  F  L  Y  L  S  *  I  K  L

28561  TACCAGTTCCTCAAGGGTAACGAAAGCCTCATGGGGAAGACTTCGTTTTCCTATAACCA  28620
         I  T  L  S  N  G  N  S  E  S  Y  G  R  R  F  C  F  S  I  P
        S  P  *  P  T  G  M  A  K  P  T  G  G  E  S  A  F  P  Y  Q
          H  D  L  L  E  W  Q  K  R  L  V  G  K  Q  L  L  L  I  N  T
```

FIG. 3 CONT'D

```
28621  TATCTGTGTCGGCCGCAAGAAAATTTTGTCGACTACCAGTTGTTTTCGTCAACAATGGCT  28680
         I  S  V  A  P  T  R  K  F  C  S  I  T  L  L  L  Q  *  R
        Y  L  C  R  R  E  K  L  V  A  S  P  *  C  F  C  N  N  G
          Y  V  C  G  A  N  K  *  F  L  Q  H  D  V  F  A  T  T  V  S

28681  CTACCATAAAGATGATAGAGCCATGGCCGGGTATACGGTTACGTAGGATACCACTTAGGG  28740
         S  P  I  E  V  I  E  T  G  A  W  I  G  I  C  G  I  T  F  G
        L  H  Y  K  *  *  R  P  V  P  G  Y  A  L  A  D  *  P  S  D
          I  T  N  R  S  D  R  Y  R  G  M  H  W  H  M  R  H  H  I  G

28741  AGCTTCCCCAGAAGACCCAACGATTAGTGGTTCGACTGTGAAGATGAGGGAGGCTACAAA  28800
         E  F  P  D  E  P  N  S  I  V  L  S  V  S  R  S  G  G  I  N
        R  S  P  T  K  Q  T  A  L  *  W  A  S  V  E  V  G  E  S  T
          R  L  P  R  R  P  Q  *  D  G  L  Q  C  K  *  E  R  R  H  K

28801  GCAGTTCCCTAGGATGATGAGTTCTTCGATAGGGATGATCCAAAGGCGGACCATGCTAAA  28860
         R  *  P  I  R  S  S  L  F  S  D  R  S  P  K  R  R  T  R  N
        E  D  L  S  G  V  V  *  S  A  I  G  V  L  N  G  G  P  V  I
          T  L  P  D  *  *  E  L  L  *  G  *  *  T  E  A  Q  Y  S  K

28861  ACGGAGTTCCGATAATACAACTTCCGAGTCCTTCCAGACGAAGATTATCAGCTGGTCCAA  28920
         Q  R  L  A  I  I  N  F  A  *  S  P  R  S  R  I  T  S  W  T
        K  G  *  P  *  *  T  S  P  E  P  L  D  A  E  L  L  R  G  P
          A  E  L  S  N  H  Q  L  S  L  F  T  Q  K  *  Y  D  V  L  N

28921  GTGCAAGAGTTAGTGCACCTGGGTTATTAGCAAGTAATTCATCTTCATTAAGATTAAAAT  28980
         *  T  R  L  *  T  S  G  I  I  T  *  *  T  S  T  I  R  I  K
        E  R  E  *  D  R  P  G  L  L  R  E  N  L  L  L  L  E  L  K
          V  N  E  I  V  H  V  W  Y  D  N  M  L  Y  F  Y  N  *  N  *

28981  CTGTAAGTCTAAGATATCATTTTGGACTATACCGACTACTCTAGCGATTAGAACAAAATC  29040
         S  M  *  I  R  Y  Y  F  R  I  H  S  I  L  D  S  I  K  N  *
        L  C  E  S  E  I  T  F  G  S  I  A  S  S  I  A  L  R  T  K
          V  N  L  N  *  L  L  V  Q  Y  P  Q  H  S  R  *  D  Q  K  L

29041  GGTTCGAACCATTTCTAAGATTTGGAGTCGTTCAGTGATTCGTTTTACGGTTCCTTTAGT  29100
         G  L  K  T  F  I  R  F  R  L  L  D  S  L  L  I  G  L  F  D
        A  L  S  P  L  S  E  L  G  *  C  T  V  L  C  F  A  L  S  I
          W  A  Q  Y  L  N  *  V  E  A  L  *  *  A  F  H  W  P  F  *

29101  CCGTATTTTAAAATTGTTTTGGAGCGGTTTTCGCTTGAGGATTATTTGTAACATTACAAG  29160
         P  M  F  N  *  C  F  R  A  L  L  S  S  R  I  F  M  T  I  N
        L  C  L  I  K  V  F  G  R  W  F  R  V  G  L  L  C  Q  L  T
          A  Y  F  K  L  L  V  E  G  F  A  F  E  *  Y  V  N  Y  H  E
```

FIG. 3 CONT'D

```
29161  TTGTCACAAAACCATTTTCTCCTGGAAGAGTTTTAAAACCATTACGACTTTACAATTTCG  29220
         L  L  T  K  T  F  S  S  R  R  L  I  K  T  I  S  F  H  *  L
        *  C  H  K  P  L  L  P  G  E  *  F  K  P  L  A  S  I  N  F
           V  T  N  Q  Y  F  L  V  K  E  F  N  Q  Y  H  Q  F  T  L  A

29221  AACCATGATTACTAGGAGTCAAAGGATAAGAACGTCTTAATCGAGGATGTGGTCCACGAA  29280
         K  T  S  I  I  R  L  K  R  N  K  C  F  *  S  R  C  W  T  S
        S  P  V  L  S  G  *  N  G  I  R  A  S  N  A  G  V  G  P  A
           Q  Y  *  H  D  E  T  E  *  E  Q  L  I  L  E  *  V  L  H  K

29281  AAAAGAAACCAAGATTTAATCTGAACCAATTTTCTCTAAGGCTCCGACTGAGTGGACAAT  29340
         K  E  K  T  R  F  *  V  Q  N  F  S  I  G  L  S  V  *  R  N
        K  K  K  P  E  L  N  S  K  T  L  L  S  E  S  A  S  E  G  T
           K  R  Q  N  *  I  L  S  P  *  F  L  N  R  P  Q  S  V  Q  *

29341  TTCTACAAAAACTTGAAGTAATAAGACCAAGATAATCCAAACTATCATGAAATGGTCCGA  29400
         F  I  N  K  F  K  M  I  R  T  R  N  P  K  I  T  S  *  W  A
        L  S  T  K  S  S  *  *  E  P  E  I  L  N  S  L  V  K  G  P
           L  H  K  Q  V  E  N  N  Q  N  *  *  T  Q  Y  Y  K  V  L  S

29401  AACTCTGTTAATACTTTCAAGAACTTCTCTTAAATTTACGAATGCAATTAAGATTAGTCT  29460
         K  L  C  N  H  F  N  K  F  L  I  *  I  S  V  N  I  R  I  L
        K  S  V  I  I  F  T  R  S  S  F  K  F  A  *  T  L  E  L  *
           Q  S  L  *  S  L  E  Q  L  S  N  L  H  K  R  *  N  *  D  S

29461  TGTGACTAAGACTAAGCAACTCAAGATTTGGAGTCGCATTTTCTCCACAATTTGTTAATG  29520
         V  S  I  R  I  R  Q  T  R  F  R  L  T  F  S  T  N  F  L  *
        F  V  S  E  S  E  N  L  E  L  G  *  R  L  L  P  T  L  C  N
           C  Q  N  Q  N  T  S  N  *  V  E  A  Y  F  L  H  *  V  I  V

29521  GTCTTGTCAAACTGAGAGAATTAAATTCACGACCATGAGTCGTGTAAAGTTTACTAAAAT  29580
         W  F  L  K  V  R  K  I  *  T  S  T  S  L  V  N  *  I  I  K
        G  S  C  N  S  E  R  L  K  L  A  P  V  *  C  M  E  F  S  K
           L  V  T  Q  S  E  *  N  L  H  Q  Y  E  A  C  K  L  H  N  *

29581  GAGGACTCCTAGTATCAAATGAACGATGAGAACTACTAGGAATACATCTTCTGAGACAAC  29640
         S  R  L  I  M  T  *  K  S  S  K  I  I  R  I  Y  F  V  R  N
        V  G  S  S  *  L  K  S  A  V  R  S  S  G  *  T  S  S  E  T
           E  Q  P  D  Y  N  V  Q  *  E  Q  H  D  K  H  L  L  S  Q  Q

29641  GAATTACTCTTACTTAGGATTAAGCTGTGATCCACCATTGGGGAGCGATAATAAGCCTTA  29700
         S  L  S  F  S  D  *  N  S  V  L  H  Y  G  R  A  I  I  R  F
        A  *  H  S  H  I  R  I  R  C  *  T  T  V  G  R  *  *  E  S
           K  I  L  I  F  G  L  E  V  S  P  P  L  G  E  S  N  N  P  I
```

FIG. 3 CONT'D

```
29701  TCCTGTGAGAGATAGTCTTACTTAAGAACGACATTATTGTCTATCTCATCCAACAATGTC  29760
         L  V  S  E  I  L  I  F  E  Q  Q  L  L  L  Y  L  L  N  N  C
        Y  S  V  R  *  *  F  S  N  K  S  Y  Y  C  I  S  Y  T  T  V
          P  C  E  R  D  S  H  I  R  A  T  I  V  S  L  T  P  Q  *  L

29761  TGATATATAATTAATCATCTTTAAAATATAAATCTGTAAACTAACAATCTCATCAATATT  29820
         V  I  Y  *  N  T  S  I  K  Y  K  S  M  Q  N  N  S  Y  N  Y
        S  *  I  N  I  L  L  F  K  I  N  L  C  K  I  T  L  T  T  I
          S  Y  I  L  *  Y  F  N  *  I  *  V  N  S  Q  *  L  L  *  L

29821  CCAAATCGACATCATATTTGCGGAGGCCCTTCTCGATAGTTAACATCACAAATTATATAT  29880
         P  K  A  T  T  Y  V  G  G  P  L  A  I  L  Q  L  T  *  Y  I
        L  N  L  Q  L  I  F  A  E  P  F  L  *  *  N  Y  H  K  I  Y
          T  *  S  Y  Y  L  R  R  R  S  S  S  D  I  T  T  N  L  I  Y

29881  ATAATCATATACTAACTTTAATTAATATCGGAAAACCTCCTTAATGTTTTTTTTTTTTTT  29940
         Y  *  Y  I  I  S  I  L  *  L  R  K  S  S  N  C  F  F  F  F
        I  N  T  Y  S  Q  F  *  N  Y  G  K  P  P  I  V  F  F  F  F
          I  L  I  H  N  F  N  I  I  A  K  Q  L  F  *  L  F  F  F  F

29941  TT                                                             29942
         F
         F
```

FIG. 3 CONT'D

HUMAN VIRUS CAUSING RESPIRATORY TRACT INFECTION AND USES THEREOF

SEQUENCE LISTING

The instant application contains a "lengthy" Sequence Listing which has been submitted via CD-R in lieu of a printed paper copy, and is hereby incorporated by reference in its entirety. Said CD-R, recorded on Jul. 13, 2004, are labeled "Copy 1" and "Copy 2", respectively, and each contains only one identical 1.54 Mb file (V6900031.APP).

1. INTRODUCTION

The present invention relates to a novel virus causing respiratory tract infection in humans ["coronavirus-HKU1 (CoV-HKU1)"]. The CoV-HKU1 is identified to be phylogenetically similar to known members of Coronaviridae. The present invention relates to a nucleotide sequence comprising the complete genomic sequence of the CoV-HKU1. The invention further relates to nucleotide sequences comprising a portion of the genomic sequence of the CoV-HKU1. The invention also relates to the deduced amino acid sequences of the complete genome of the CoV-HKU1. The invention further relates to the nucleic acids and peptides encoded by and/or derived from these sequences and their use in diagnostic methods and therapeutic methods, such as for immunogens. The invention further encompasses chimeric or recombinant viruses encoded by said nucleotide sequences and antibodies directed against polypeptides encoded by the nucleotide sequence. Furthermore, the invention relates to vaccine preparations comprising the CoV-HKU1 recombinant and chimeric forms of said virus as well as protein extracts and subunits of said virus.

2. BACKGROUND OF THE INVENTION

In January, 2004, a 71-year-old Chinese man was admitted to hospital because of fever and chills for two days associated with sore throat, rhinorrhoea, productive cough with purulent sputum, headache and nausea. He had history of pulmonary tuberculosis more than 40 years ago complicated by cicatrization of right upper lobe and bronchiectasis with chronic *Pseudomonas aeruginosa* colonization of airways. He was a chronic smoker and also had chronic obstructive airway disease, hyperlipidemia, and asymptomatic abdominal aortic aneurysm. He had just returned from Shenzhen of China three days before admission. During his three-day trip to Shenzhen, he had no history of contact with or consumption of wild animals. On admission, his oral temperature was 37.6° C. Physical examination showed tracheal deviation to the right and inspiratory crackles over the anterior left lower zone. His haemoglobin level was 14.7 g/dL, total white cell count 12.1× $10^9$/L, with neutrophil 9.7×$10^9$/L, lymphocyte 1.6×$10^9$/L and monocyte 0.5×$10^9$/L, and plate count 303×$10^9$/L. His liver and renal function tests were within normal limits. Chest radiograph showed right upper lobe collapse and new patchy infiltrates over the left lower zone. Blood culture was performed. Empirical oral amoxicillin/clavulanate and azithromycin were commenced. Nasopharyngeal aspirates for direct antigen detection for respiratory viruses, RT-PCR for influenza A virus, human metapneumovirus and SARS-CoV, and viral cultures were negative. Sputum for bacterial culture only recovered *P. aeruginosa*. Sputum for mycobacterial culture was negative. Blood culture was negative. Paired sera for antibodies against *Mycoplasma*, *Chlamydia*, *Legionella*, and SARS-CoV did not show any rise in antibody titres. His fever subsided two days after admission. His cough improved and he was discharged after five days of hospitalization. Amoxicillin/clavulanate and azithromycin were continued for a total of seven days. The present inventors were the group involved in the investigation of this patient. All tests for identifying commonly recognized viruses and bacteria were negative in these patients. The etiologic agent responsible for this disease was not known until the complete genome of CoV-HKU1 from this patient by the present inventors as disclosed herein. Namely, the present invention discloses a novel human virus that has been identified from a patient suffering from pneumonia. The invention is useful in both clinical and scientific research applications.

3. SUMMARY OF INVENTION

The present invention is based upon the inventor's complete genome sequencing of a novel virus ("CoV-HKU1") causing pneumonia in humans. The virus was discovered from a patient suffering from pneumonia in Hong Kong. The virus is a single-stranded RNA virus of positive polarity which belongs to the order, Nidovirales, of the family, Coronaviridae. Accordingly, the invention relates to CoV-HKU1 that phylogenetically relates to known members of Coronaviridae. In a specific embodiment, the invention provides complete genomic sequence of CoV-HKU1. In a preferred embodiment, the virus comprises a nucleotide sequence of SEQ ID NO:1 and/or 3. In another specific embodiment, the invention provides nucleic acids isolated from the virus. The virus preferably comprises a nucleotide sequence of SEQ ID NO:1 and/or 3 in its genome. In a specific embodiment, the present invention provides isolated nucleic acid molecules comprising or, alternatively, consisting of the nucleotide sequence of SEQ ID NO:1, a complement thereof or a portion thereof, preferably at least 5, 10, 15, 20, 25, 30, 35, 40, 45, 100, 150, 200, 300, 350, or more contiguous nucleotides of the nucleotide sequence of SEQ ID NO:1, or a complement thereof. In another specific embodiment, the present invention provides isolated nucleic acid molecules comprising or, alternatively, consisting of the nucleotide sequence of SEQ ID NO:3, a complement thereof or a portion thereof, preferably at least 5, 10, 15, 20, 25, 30, 35, 40, 45, 100, 150, 200, 300, 350, 400, 450, 500, 550, 600, 650, 700, 750, 800, 850, 900, 950, 1,000, 1,050, 1,100, 1,150, 1,200, 2,000, 3,000, 4,000, 5,000, 6,000, 7,000, 8,000, 9,000, 10,000, 11,000, 12,000, 13,000, 14,000, 15,000, 16,000, 17,000, 18,000, 19,000, 20,000, 21,000, 22,000, 23,000, 24,000, 25,000, 26,000, 27,000, 28,000, 29,000 or more contiguous nucleotides of the nucleotide sequence of SEQ ID NO:3, or a complement thereof. Furthermore, in another specific embodiment, the invention provides isolated nucleic acid molecules which hybridize under stringent conditions, as defined herein, to a nucleic acid molecule having the sequence of SEQ ID NO:1 or 3, or a complement thereof. In preferred embodiments, such nucleic acid molecules encode amino acid sequences that have biological activities exhibited by the polypeptides encoded by the nucleotide sequence of SEQ ID NO:1 or 3. In another specific embodiment, the invention provides isolated polypeptides or proteins that are encoded by a nucleic acid molecule comprising or, alternatively consisting of a nucleotide sequence that is at least 5, 10, 15, 20, 25, 30, 35, 40, 45, 100, 150, 200, 300, 350, or more contiguous nucleotides of the nucleotide sequence of SEQ ID NO:1, or a complement thereof. In yet another specific embodiment, the invention provides isolated polypeptides or proteins that are encoded by a nucleic acid molecule comprising or, alternatively consisting of a nucleotide sequence that is at least 5, 10, 15, 20, 25, 30, 35, 40, 45, 100, 150, 200, 300, 350, 400, 450, 500, 550, 600, 650, 700, 750, 800, 850, 900, 950, 1,000, 1,050, 1,100, 1,150, 1,200, 2,000, 3,000, 4,000, 5,000, 6,000, 7,000, 8,000, 9,000, 10,000, 11,000, 12,000, 13,000, 14,000, 15,000, 16,000, 17,000, 18,000, 19,000, 20,000, 21,000, 22,000, 23,000, 24,000, 25,000, 26,000, 27,000, 28,000, 29,000 or more contiguous nucleotides of the nucleotide sequence of SEQ ID NO:3, or a complement thereof. The polypeptides or proteins include those having the amino acid sequences of SEQ ID NO:2 and SEQ ID NOS:34-2918 shown in FIGS. 2 and 3, respectively. The invention further provides proteins or polypeptides that are isolated from the CoV-HKU1, including viral proteins isolated from cells infected with the virus but not present in comparable uninfected cells. The polypeptides or the proteins of the present invention preferably have a biological activity of the protein (including antigenicity and/or immunogenicity) encoded by the nucleotide sequence that is at least 5, 10, 15, 20, 25, 30, 35, 40, 45, 100, 150, 200, 300, 350, or more contiguous nucleotides of the nucleotide sequence of SEQ ID NO:1. In other embodiments, the polypeptides or the proteins of the present invention have a biological activity of the protein (including antigenicity and/or immunogenicity) encoded by a nucleotide sequence that is at least 5, 10, 15, 20, 25, 30, 35, 40, 45, 100, 150, 200, 300, 350, 400, 450, 500, 550, 600, 650, 700, 750, 800, 850, 900, 950, 1,000, 1,050, 1,100, 1,150, 1,200, 2,000, 3,000, 4,000, 5,000, 6,000, 7,000, 8,000, 9,000, 10,000, 11,000, 12,000, 13,000, 14,000, 15,000, 16,000, 17,000, 18,000, 19,000, 20,000, 21,000, 22,000, 23,000, 24,000, 25,000, 26,000, 27,000, 28,000, 29,000 or more contiguous nucleotides of the nucleotide sequence of SEQ ID NO:3, or a complement thereof.

In one aspect, the invention relates to the use of CoV-HKU1 for diagnostic methods. In a specific embodiment, the invention provides a method of detecting in a biological sample an antibody that immunospecifically binds to the CoV-HKU1, or any proteins or polypeptides thereof. In another specific embodiment, the invention provides a method of detecting in a biological sample an antibody that immunospecifically binds to the CoV-HKU1-infected cells. In yet another specific embodiment, the invention provides a method of screening for an antibody that immunospecifically binds and neutralizes CoV-HKU1. Such an antibody is useful for a passive immunization or immunotherapy of a subject infected with CoV-HKU1.

The invention further relates to the use of the sequence information of the isolated virus for diagnostic methods. In a specific embodiment, the invention provides nucleic acid molecules which are suitable for use as primers consisting of or comprising the nucleotide sequence of SEQ ID NO:1 or 3, a complement thereof, or at least a portion of the nucleotide sequence thereof. In another specific embodiment, the invention provides nucleic acid molecules which are suitable for hybridization to CoV-HKU1 nucleic acid, including, but not limited to, as PCR primers, Reverse Transcriptase primers, probes for Southern or Northern analysis or other nucleic acid hybridization analysis for the detection of CoV-HKU1 nucleic acids, e.g., consisting of or comprising the nucleotide sequence of SEQ ID NO:1 or 3, a complement thereof, or a portion thereof.

The invention further provides antibodies that specifically bind a polypeptide of the invention encoded by the nucleotide sequence of SEQ ID NO:1 or 3 or a fragment thereof, including the polypeptide having the amino acid sequence of SEQ ID NO:2 or SEQ ID NOS:34-2918 shown in FIGS. 2 and 3, or encoded by a nucleic acid comprising a nucleotide sequence that hybridizes under stringent conditions to the nucleotide sequence of SEQ ID NO:1 or 3 and/or any CoV-HKU1 epitope, having one or more biological activities of a polypeptide of the invention. The invention further provides antibodies that specifically bind cells or tissues that are infected by CoV-HKU1. Such antibodies include, but are not limited to polyclonal, monoclonal, bi-specific, multi-specific, human, humanized, chimeric antibodies, single chain antibodies, Fab fragments, F(ab')$_2$ fragments, disulfide-linked Fvs, intrabodies and fragments containing either a VL or VH domain or even a complementary determining region (CDR) that specifically binds to a polypeptide of the invention.

In one embodiment, the invention provides methods for detecting the presence, activity or expression of the CoV-HKU1 of the invention in a biological material, such as cells, blood, saliva, urine, and so forth. The increased or decreased activity or expression of the CoV-HKU1 in a sample relative to a control sample can be determined by contacting the biological material with an agent which can detect directly or indirectly the presence, activity or expression of the CoV-HKU1. In a specific embodiment, the detecting agents are the antibodies or nucleic acid molecules of the present invention. Antibodies of the invention may also be used to detect and/or treat other coronaviruses, such as Severe Acute Respiratory Syndrome ("SARS") viruses.

In another embodiment, the invention provides vaccine preparations, comprising the CoV-HKU1 recombinant and chimeric forms of said virus, or protein subunits of the virus. In a specific embodiment, the present invention provides methods of preparing recombinant or chimeric forms of CoV-HKU1. In another specific invention, the vaccine preparations of the present invention comprise a nucleic acid or fragment of the CoV-HKU1, or nucleic acid molecules having the sequence of SEQ ID NO:1 or 3, or a fragment thereof. In another embodiment, the invention provides vaccine preparations comprising one or more polypeptides isolated from or produced from nucleic acid of CoV-HKU1. In a specific embodiment, the vaccine preparations comprise a polypeptide of the invention encoded by the nucleotide sequence of SEQ ID NO:1 or 3, or a fragment thereof, including the polypeptides having the amino acid sequences of SEQ ID NO:2 or SEQ ID NOS:34-2918 shown in FIGS. 2 and 3, respectively. Furthermore, the present invention provides methods for treating, ameliorating, managing or preventing respiratory tract infections caused by CoV-HKU1 by administering to a subject in need thereof the anti-viral agents of the present invention, alone or in combination with various anti-viral agents as well as adjuvants, and/or other pharmaceutically acceptable excipients.

In another aspect, the present invention provides methods for preventing or inhibiting, under a physiological condition, binding to a host cell, or infection of a host cell, or replication in a host cell, of CoV-HKU1 or a virus comprising a nucleic acid molecule comprising the nucleotide sequence of SEQ ID NO:1 or 3 or a complement thereof, by administering to the host cell the anti-viral agents of the present invention, alone or in combination with other anti-viral agents. In a specific embodiment, the anti-viral agent of the invention includes the immunogenic preparations of the invention or an antibody that immunospecifically binds CoV-HKU1 or any CoV-HKU1 epitope and/or neutralizes CoV-HKU1. In another specific embodiment, the anti-viral agent is a polypeptide or protein of the present invention or a nucleic acid molecule of the invention. In a specific embodiment, the host cell is a mammalian cell, including a cell of human, primates, cows, horses, sheep, pigs, fowl (e.g., chickens), goats, cats, dogs, hamsters, mice and rats. Preferably a host cell is a primate cell, and most preferably a human cell. Furthermore, the present invention provides pharmaceutical compositions comprising anti-viral agents of the present invention and a pharmaceutically acceptable carrier. The invention also provides kits containing a pharmaceutical composition of the present invention.

3.1 Definitions

The term "an antibody or an antibody fragment that immunospecifically binds a polypeptide of the invention" as used herein refers to an antibody or a fragment thereof that immunospecifically binds to the polypeptide encoded by the nucleotide sequence of SEQ ID NO:1 or 3, or a fragment thereof, and does not non-specifically bind to other polypeptides. An antibody or a fragment thereof that immunospecifically binds to the polypeptide of the invention may cross-react with other antigens. Preferably, an antibody or a fragment thereof that immunospecifically binds to a polypeptide of the invention does not cross-react with other antigens. An antibody or a fragment thereof that immunospecifically binds to the polypeptide of the invention, can be identified by, for example, immunoassays or other techniques known to those skilled in the art.

An "isolated" or "purified" peptide or protein is substantially free of cellular material or other contaminating proteins from the cell or tissue source from which the protein is derived, or substantially free of chemical precursors or other chemicals when chemically synthesized. The language "substantially free of cellular material" includes preparations of a polypeptide/protein in which the polypeptide/protein is separated from cellular components of the cells from which it is isolated or recombinantly produced. Thus, a polypeptide/protein that is substantially free of cellular material includes preparations of the polypeptide/protein having less than about 30%, 20%, 10%, 5%, 2.5%, or 1%, (by dry weight) of contaminating protein. When the polypeptide/protein is recombinantly produced, it is also preferably substantially free of culture medium, i.e., culture medium represents less than about 20%, 10%, or 5% of the volume of the protein preparation. When polypeptide/protein is produced by chemical synthesis, it is preferably substantially free of chemical precursors or other chemicals, i.e., it is separated from chemical precursors or other chemicals which are involved in the synthesis of the protein. Accordingly, such preparations of the polypeptide/protein have less than about 30%, 20%, 10%, 5% (by dry weight) of chemical precursors or compounds other than polypeptide/protein fragment of interest. In a preferred embodiment of the present invention, polypeptides/proteins are isolated or purified.

An "isolated" nucleic acid molecule is one which is separated from other nucleic acid molecules which are present in the natural source of the nucleic acid molecule. Moreover, an "isolated" nucleic acid molecule, such as a cDNA molecule, can be substantially free of other cellular material, or culture medium when produced by recombinant techniques, or substantially free of chemical precursors or other chemicals when chemically synthesized. In a preferred embodiment of the invention, nucleic acid molecules encoding polypeptides/proteins of the invention are isolated or purified. The term "isolated" nucleic acid molecule does not include a nucleic acid that is a member of a library that has not been purified away from other library clones containing other nucleic acid molecules.

The term "portion" or "fragment" as used herein refers to a fragment of a nucleic acid molecule containing at least about 10, 15, 25, 30, 35, 40, 45, 100, 150, 200, 250, 300, 350, 400, 450, 500, 550, 600, 650, 700, 750, 800, 850, 900, 950, 1000, 1050, 1100, 1150, 1200, 1250, 1300, 1350, 2,000, 3,000, 4,000, 5,000, 6,000, 7,000, 8,000, 9,000, 10,000, 11,000, 12,000, 13,000, 14,000, 15,000, 16,000, 17,000, 18,000, 19,000, 20,000, 21,000, 22,000, 23,000, 24,000, 25,000, 26,000, 27,000, 28,000, 29,000, or more contiguous nucleic acids in length of the relevant nucleic acid molecule and having at least one functional feature of the nucleic acid molecule (or the encoded protein has one functional feature of the protein encoded by the nucleic acid molecule); or a fragment of a protein or a polypeptide containing at least 5, 10, 15, 20, 25, 30, 35, 40, 45, 50, 55, 60, 65, 70, 75, 80, 90, 100, 120, 140, 160, 180, 200, 220, 240, 260, 280, 300, 320, 340, 360, 380, 400, 500, 600, 700, 800, 900, 1,000, 1,500, 2,000, 2,500, 3,000, 3,500, 4,000, 4,100, 4,200, 4,300, 4,350, 4,360, 4,370, 4,380 amino acid residues in length of the relevant protein or polypeptide and having at least one functional feature of the protein or polypeptide.

The term "having a biological activity of the protein" or "having biological activities of the polypeptides of the invention" refers to the characteristics of the polypeptides or proteins having a common biological activity similar or identical structural domain and/or having sufficient amino acid identity to the polypeptide encoded by the nucleotide sequence of SEQ ID NO:1 or 3, or the polypeptide having the amino acid sequence of SEQ ID NO:2, or a complement thereof. Such common biological activities of the polypeptides of the invention include antigenicity and immunogenicity.

The term "under stringent condition" refers to hybridization and washing conditions under which nucleotide sequences having at least 70%, at least 75%, at least 80%, at least 85%, at least 90%, or at least 95% identity to each other remain hybridized to each other. Such hybridization conditions are described in, for example but not limited to, Current Protocols in Molecular Biology, John Wiley & Sons, N.Y. (1989), 6.3.1-6.3.6.; Basic Methods in Molecular Biology, Elsevier Science Publishing Co., Inc., N.Y. (1986), pp. 75-78, and 84-87; and Molecular Cloning, Cold Spring Harbor Laboratory, N.Y. (1982), pp. 387-389, and are well known to those skilled in the art. A preferred, non-limiting example of stringent hybridization conditions is hybridization in 6× sodium chloride/sodium citrate (SSC), 0.5% SDS at about 68° C. followed by one or more washes (e.g., about 5 to 30 min each) in 2×SSC, 0.5% SDS at room temperature. Another preferred, non-limiting example of stringent hybridization conditions is hybridization in 6×SSC at about 45° C. followed by one or more washes (e.g., about 5 to 30 min each) in 0.2×SSC, 0.1% SDS at about 45-65° C.

The term "variant" as used herein refers either to a naturally occurring genetic mutant of CoV-HKU1 or a recombinantly prepared variation of CoV-HKU1 each of which contain one or more mutations in its genome compared to CoV-HKU1. The term "variant" may also refers either to a naturally occurring variation of a given peptide or a recombinantly prepared variation of a given peptide or protein in which one or more amino acid residues have been modified by amino acid substitution, addition, or deletion.

4. DESCRIPTION OF FIGURES

FIG. 1 shows a partial DNA sequence (SEQ ID NO:1) and its deduced amino acid sequence (SEQ ID NO:2) obtained from CoV-HKU1 that has 91% amino acid identity to the RNA-dependent RNA polymerase protein of known Coronaviruses.

FIG. 2 shows the entire genomic DNA sequence (SEQ ID NO:3) of CoV-HKU1 and its deduced amino acid sequences therefrom in three frames. An asterisk (*) indicates a stop codon which marks the end of a peptide. The first-frame translation and amino acid sequences: SEQ ID NOS:34-456; the second-frame translation and amino acid sequences: SEQ ID NOS:457-723; and the third-frame translation and amino acid sequences: SEQ ID NOS:724-1318.

FIG. 3 shows the complement (SEQ ID NO:1319) of the entire genomic DNA sequence (SEQ ID NO:3) of CoV-HKU1 in 3'→5' orientation and its deduced amino acid sequences therefrom in three frames. An asterisk (*) indicates a stop codon which marks the end of a peptide. The first-frame translation and amino acid sequences: SEQ ID NOS:1319-1907; the second-frame translation and amino acid sequences: SEQ ID NO:1908-2453; and the third-frame translation and amino acid sequences: SEQ ID NOS:2454-2918.

FIG. 4 shows the genome organization of CoV-HKU1. Arrows indicate the putative cleavage sites of the polyprotein encoded by ORF 1a and ORF 1b. The peptides are shown in SEQ ID NOS:15-17, respectively, in order of appearance.

Figure 5A:
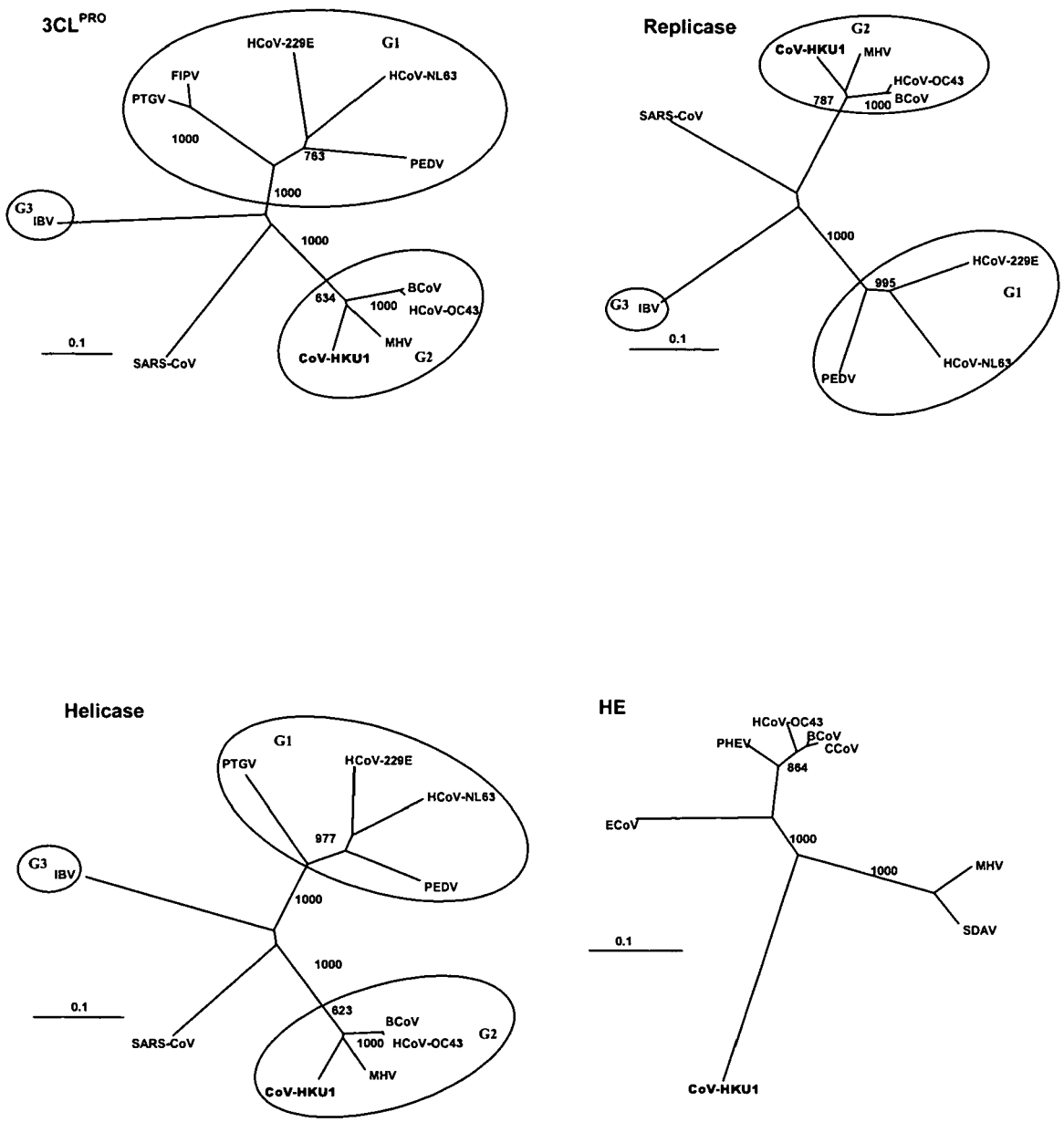
Figure 5B:
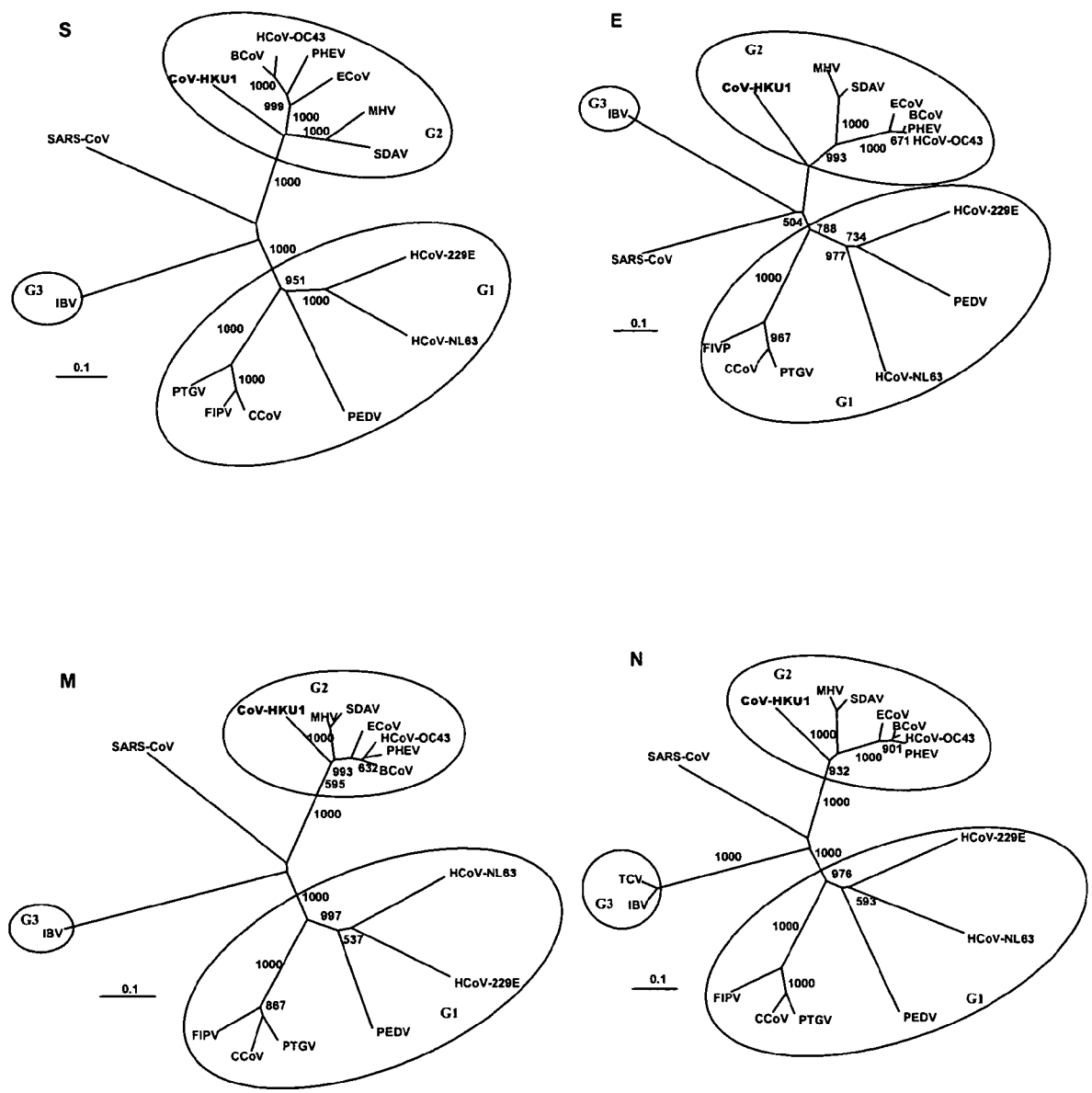

FIG. 5A shows the phylogenetic analysis of the chymotrypsin like protease ($3CL^{pro}$), replicase (Rep), helicase (Hel), and hemagglutinin esterase (HE); and FIG. 5B shows that of the spike (S), envelope (E), membrane (M), and nucleocapsid (N) proteins of CoV-HKU1. The trees were constructed by the neighbor joining method using the Jukes-Cantor correction and bootstrap values were calculated from 1000 trees. A total of 303, 928, 603, 386, 1356, 82, 223 and 441 amino acid positions in $3CL^{pro}$, Rep, Hel, HE, S, E, M, and N respectively were included in the analysis. The scale bar indicates the estimated number of substitutions per 10 amino acids.

Figure 6:
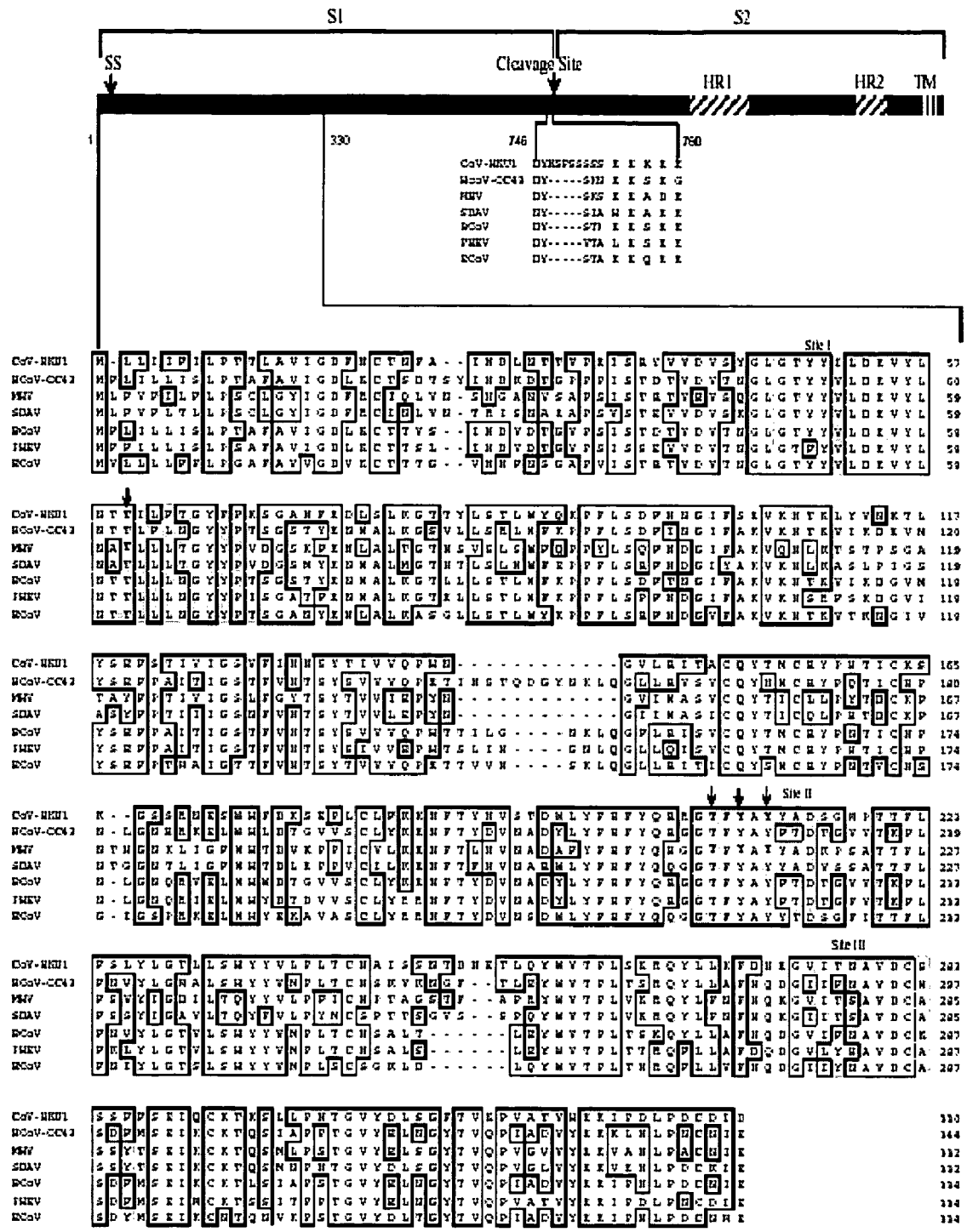

FIG. 6 shows the important features of the S protein of CoV-HKU1 (residues 7-336 of SEQ ID NO:420) in comparison with those of other viruses, i.e., HCoV-OC43 (human coronavirus OC43; SEQ ID NO:21), MHV (murine hepatitis virus; SEQ ID NO:22), SDAV (rat sialodacryoadenitis encephalomyelitis virus; SEQ ID NO:23), BCoV (bovine coronavirus; SEQ ID NO:24), PHEV (porcine hemagglutinating encephalomyelitis virus; SEQ ID NO:25), and ECoV (equine coronavirus; SEQ ID NO:26). The cleavage site peptides are shown in residues 752-766 of SEQ ID NO:420 and SEQ ID NOS:28-33, respectively, in order of appearance.

Figure 7:
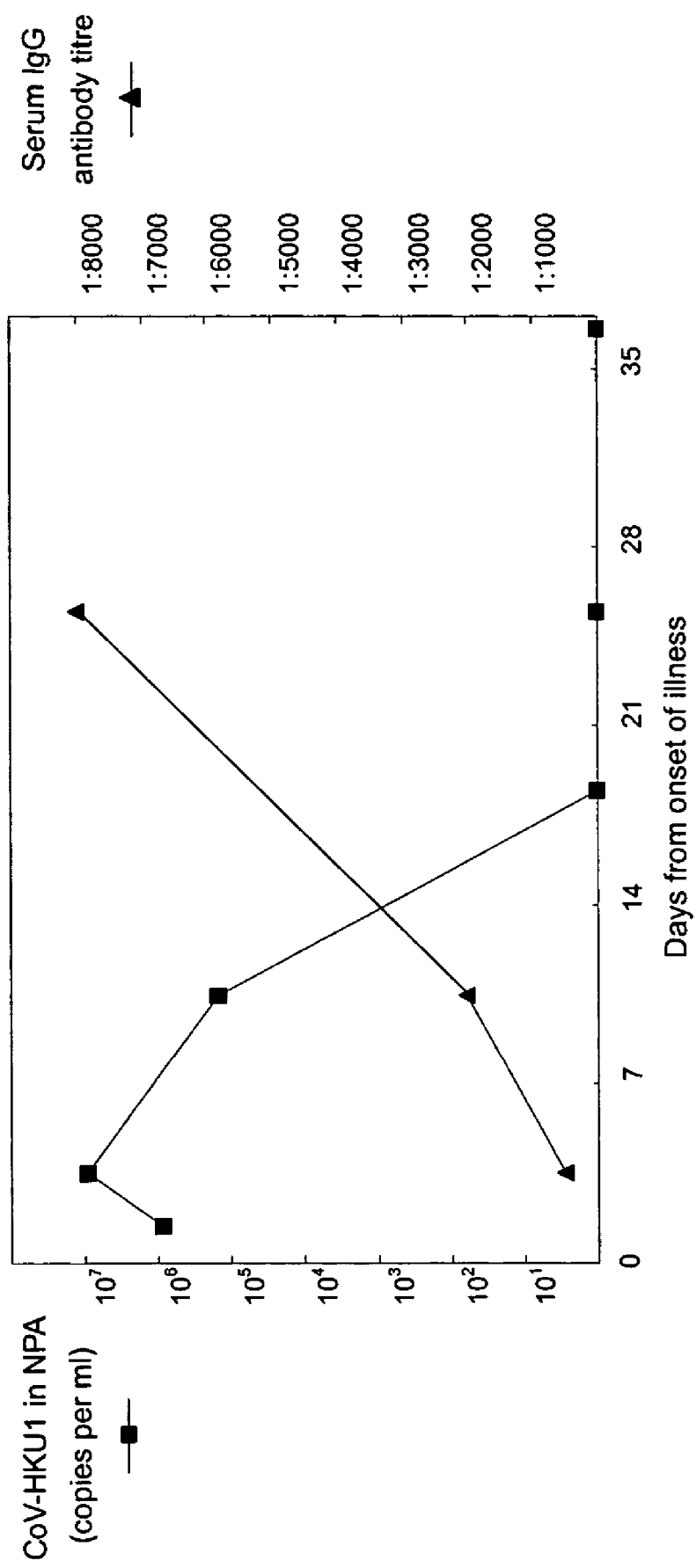

FIG. 7 shows the sequential quantitative RT-PCR (closed squares; copies/ml) for CoV-HKU1 in nasopharyngeal aspirates; and serum IgG antibody titers against N protein of CoV-HKU1 (closed triangles).

Figure 8:
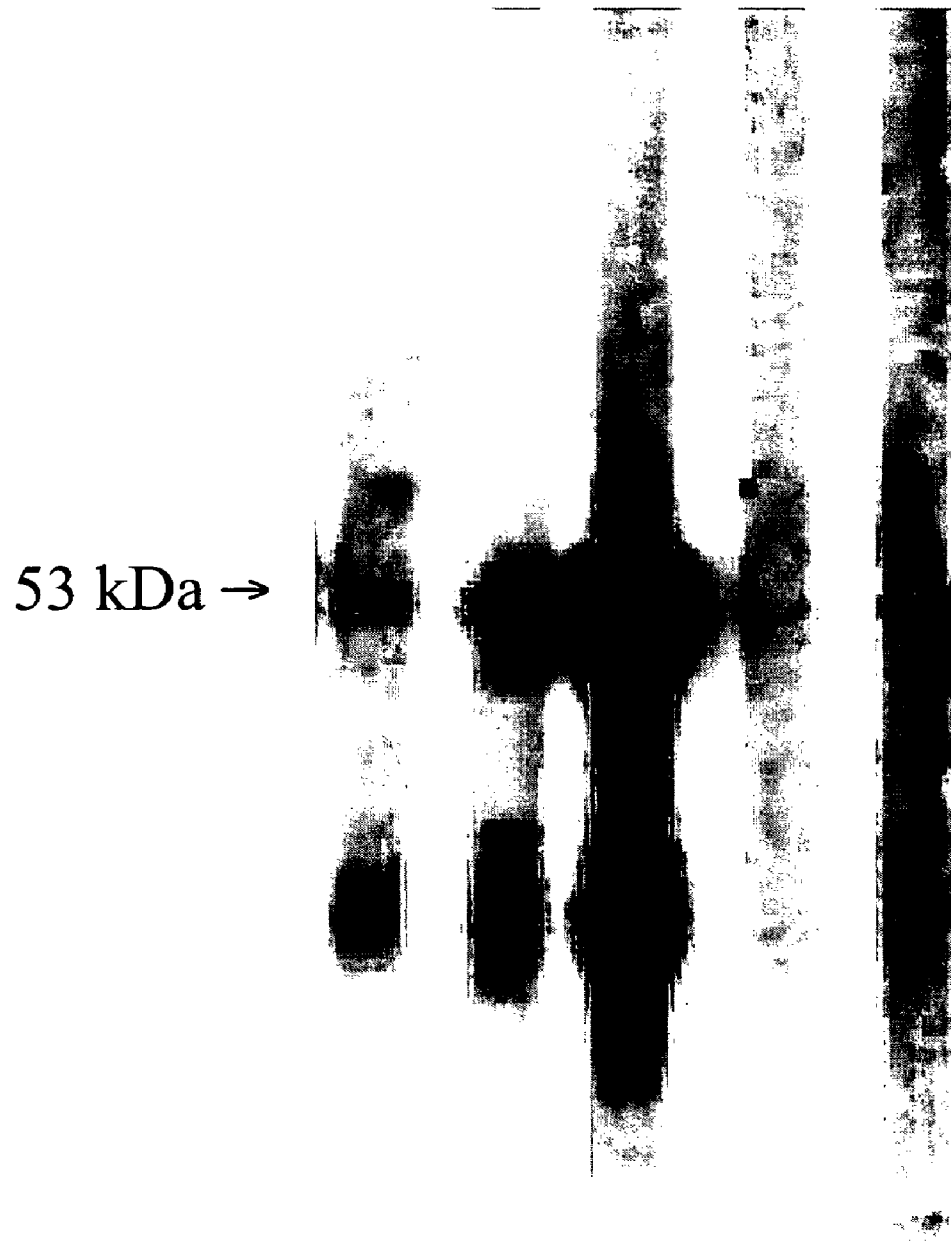

FIG. 8 shows the Western blot analysis of purified recombinant CoV-HKU1 N protein antigen. Prominent immunoreactive protein bands of about 53 kDa were detected by the Western blot using the patient's sera obtained during the second and fourth weeks of the illness (lanes 2 and 3). Only very faint bands were observed with the serum samples obtained from the patient during the first week of the illness (lane 1) and two healthy blood donors (lane 4 and 5), respectively.

5. DETAILED DESCRIPTION OF THE INVENTION

The present invention relates to the CoV-HKU1 that phylogenetically relates to known Coronaviruses. In a specific embodiment, CoV-HKU1 comprises a nucleotide sequence of SEQ ID NO:1 and/or 3. In a specific embodiment, the present invention provides isolated nucleic acid molecules of the CoV-HKU1, comprising, or, alternatively consisting of the nucleotide sequence of SEQ ID NO:1 and/or 3, a complement thereof or a portion thereof. In another specific embodiment, the invention provides isolated nucleic acid molecules which hybridize under stringent conditions, as defined herein, to a nucleic acid molecule having the sequence of SEQ ID NO:1 or 3, or specific genes of known member of Coronaviridae, or a complement thereof. In another specific embodiment, the invention provides isolated polypeptides or proteins that are encoded by a nucleic acid molecule comprising a nucleotide sequence that is at least about 5, 10, 15, 20, 25, 30, 35, 40, 45, 100, 150, 200, 300, 350, or more contiguous nucleotides of the nucleotide sequence of SEQ ID NO:1, or a complement thereof. In yet another specific embodiment, the invention provides isolated polypeptides or proteins that are encoded by a nucleic acid molecule comprising or, alternatively consisting of a nucleotide sequence that is at least 5, 10, 15, 20, 25, 30, 35, 40, 45, 100, 150, 200, 300, 350, 400, 450, 500, 550, 600, 650, 700, 750, 800, 850, 900, 950, 1,000, 1,050, 1,100, 1,150, 1,200, 2,000, 3,000, 4,000, 5,000, 6,000, 7,000, 8,000, 9,000, 10,000, 11,000, 12,000, 13,000, 14,000, 15,000, 16,000, 17,000, 18,000, 19,000, 20,000, 21,000, 22,000, 23,000, 24,000, 25,000, 26,000, 27,000, 28,000, 29,000 or more contiguous nucleotides of the nucleotide sequence of SEQ ID NO:3, or a complement thereof. The polypeptides or the proteins of the present invention preferably have one or more biological activities of the proteins encoded by the sequence of SEQ ID NO:1, 3, or the native viral proteins containing the amino acid sequences encoded by the sequence of SEQ ID NO:1 or 3.

The invention further relates to the use of the sequence information of the isolated virus for diagnostic and therapeutic methods. In a specific embodiment, the invention provides the entire nucleotide sequence of CoV-HKU1 (SEQ ID NO:3), or fragments, or complement thereof. Furthermore, the present invention relates to a nucleic acid molecule that hybridizes any portion of the genome of the CoV-HKU1 (SEQ ID NO:3) under the stringent conditions. In a specific embodiment, the invention provides nucleic acid molecules which are suitable for use as primers consisting of or comprising the nucleotide sequence of SEQ ID NO:1 or 3, or a complement thereof, or a portion thereof. In another specific embodiment, the invention provides nucleic acid molecules which are suitable for use as hybridization probes for the detection of nucleic acids encoding a polypeptide of the invention, consisting of or comprising the nucleotide sequence of SEQ ID NO:1 or 3, a complement thereof, or a portion thereof. The invention further encompasses chimeric or recombinant viruses or viral proteins encoded by said nucleotide sequences.

The invention further provides antibodies that specifically bind a polypeptide of the invention encoded by the nucleotide sequence of SEQ ID NO:1 or 3, or a fragment thereof, or any CoV-HKU1 epitope as well as the polypeptides having the amino acid sequences of SEQ ID NO:2 and SEQ ID NOS: 34-2918, respectively, shown in FIGS. 2 and 3. Such antibodies include, but are not limited to polyclonal, monoclonal, bi-specific, multi-specific, human, humanized, chimeric antibodies, single chain antibodies, Fab fragments, $F(ab')_2$ fragments, disulfide-linked Fvs, intrabodies and fragments containing either a VL or VH domain or even a complementary determining region (CDR) that specifically binds to a polypeptide of the invention.

In one embodiment, the invention provides methods for detecting the presence, activity or expression of the CoV-HKU1 of the invention in a biological material, such as cells, blood, saliva, urine, sputum, nasopharyngeal aspirates, and so forth. The presence of the CoV-HKU1 in a sample can be determined by contacting the biological material with an agent which can detect directly or indirectly the presence, activity or expression of the CoV-HKU1. In a specific embodiment, the detection agents are the antibodies of the present invention. In another embodiment, the detection agent is a nucleic acid of the present invention.

In another embodiment, the invention provides vaccine preparations comprising the CoV-HKU1 recombinant and chimeric forms of said virus, or subunits of the virus.

The present invention further provides methods of preparing recombinant or chimeric forms of CoV-HKU1. In another specific embodiment, the vaccine preparations of the present invention comprise one or more nucleic acid molecules comprising or consisting of the sequence of SEQ ID NO:1 and/or 3, or a fragment thereof. In another embodiment, the invention provides vaccine preparations comprising one or more polypeptides of the invention encoded by a nucleotide sequence comprising or consisting of the nucleotide sequence of SEQ ID NO:1 and/or 3, or a fragment thereof, including the polypeptides having the amino acid sequences of SEQ ID NO:2 or SEQ ID NOS:34-2918 shown in FIGS. 2 and 8. Furthermore, the present invention provides methods for treating, ameliorating, managing, or preventing respiratory tract infections by administering to a subject in need thereof the anti-viral agents of the present invention, alone or in combination with other antivirals [e.g., amantadine, rimantadine, gancyclovir, acyclovir, ribavirin, penciclovir, oseltamivir, foscarnet zidovudine (AZT), didanosine (ddI), lamivudine (3TC), zalcitabine (ddC), stavudine (d4T), nevirapine, delavirdine, indinavir, ritonavir, vidarabine, nelfinavir, saquinavir, relenza, tamiflu, pleconaril, interferons, etc.], steroids and corticosteroids such as prednisone, cortisone, fluticasone and glucocorticoid, antibiotics, analgesics, bronchodialaters, or other treatments for respiratory and/or viral infections. In one aspect, the anti-viral agent of the present invention prevents or inhibit the binding of the virus or viral proteins to a host cell under a physiological condition, thereby preventing or inhibiting the infection of the host cell by the virus. In another aspect, the anti-viral agent of the invention prevents or inhibits replication of the viral nucleic acid molecules in the host cell under a physiological condition by interacting with the viral nucleic acid molecules or its transcription mechanisms. In a specific embodiment, the anti-viral agent of the invention includes the vaccine or immunogenic preparations of the invention or an antibody that immunospecifically binds CoV-HKU1 or any CoV-HKU1 epitope and may neutralizes CoV-HKU1. In another specific embodiment, the anti-viral agent is a polypeptide or protein of the invention or a nucleic acid molecule of the invention. In addition, the present invention provides a method of preventing or inhibiting replication in a host cell of a nucleic acid molecule having the nucleotide sequence of SEQ ID NO:1 and/or 3, or inhibiting the activities of the polypeptides encoded by the nucleotide sequence of SEQ ID NO:1 and/or 3, a complement thereof, or a portion thereof, including the polypeptides having the amino acid sequence of SEQ ID NO:2 or SEQ ID NO:34-2918 shown in FIGS. 2 and 8, by administering to said host cell the anti-viral agent of the invention. In a specific embodiment the host cell is a mammalian cell, such as a cell of humans, primates, horses, cows, sheep, pigs, goats, dogs, cats, arivan species and rodents. Preferably, the cell is a primate cell and most preferably a human cell.

Furthermore, the present invention provides pharmaceutical compositions comprising anti-viral agents of the present invention and a pharmaceutically acceptable carrier. The present invention also provides kits comprising pharmaceutical compositions of the present invention.

5.1 Recombinant and Chimeric CoV-HKU1

The present invention encompasses recombinant or chimeric viruses encoded by viral vectors derived from the genome of CoV-HKU1 or natural variants thereof. In a specific embodiment, a recombinant virus is one derived from the CoV-HKU1. In a specific embodiment, the virus has a nucleotide sequence of SEQ ID NO:3. In another specific embodiment, a recombinant virus is one derived from a natural variant of CoV-HKU1. A natural variant of CoV-HKU1 has a sequence that is different from the genomic sequence (SEQ ID NO:3) of CoV-HKU1, due to one or more naturally occurred mutations, including, but not limited to, point mutations, rearrangements, insertions, deletions etc., to the genomic sequence that may or may not result in a phenotypic change. In accordance with the present invention, a viral vector which is derived from the genome of the CoV-HKU, is one that contains a nucleic acid sequence that encodes at least a part of one ORF of the CoV-HKU1. In a specific embodiment, the ORF comprises or consists of a nucleotide sequence of SEQ ID NO:1 or a fragment thereof. In a specific embodiment, there are more than one ORF within the nucleotide sequence of SEQ ID NO:3, or a fragment thereof. In another embodiment, the polypeptides encoded by the ORF comprises or consists of amino acid sequences of SEQ ID NO:34-2918 shown in FIGS. 2 and 8, or SEQ ID NO:2, or a fragment thereof. In accordance with the present invention these viral vectors may or may not include nucleic acids that are non-native to the viral genome.

In another specific embodiment, a chimeric virus of the invention is a recombinant CoV-HKU1 which further comprises a heterologous nucleotide sequence. In accordance with the invention, a chimeric virus may be encoded by a nucleotide sequence in which heterologous nucleotide sequences have been added to the genome or in which endogenous or native nucleotide sequences have been replaced with heterologous nucleotide sequences.

According to the present invention, the chimeric viruses are encoded by the viral vectors of the invention which further comprise a heterologous nucleotide sequence. In accordance with the present invention a chimeric virus is encoded by a viral vector that may or may not include nucleic acids that are non-native to the viral genome. In accordance with the invention a chimeric virus is encoded by a viral vector to which heterologous nucleotide sequences have been added, inserted or substituted for native or non-native sequences. In accordance with the present invention, the chimeric virus may be encoded by nucleotide sequences derived from different strains or variants of CoV-HKU1. In particular, the chimeric virus is encoded by nucleotide sequences that encode antigenic polypeptides derived from different strains or variants of CoV-HKU1.

A chimeric virus may be of particular use for the generation of recombinant vaccines protecting against two or more viruses (Tao et al., J. Virol. 72, 2955-2961; Durbin et al., 2000, J. Virol. 74, 6821-6831; Skiadopoulos et al., 1998, J. Virol. 72, 1762-1768 (1998); Teng et al., 2000, J. Virol. 74, 9317-9321). For example, it can be envisaged that a virus vector derived from the CoV-HKU1 expressing one or more proteins of variants of CoV-HKU1, or vice versa, will protect a subject vaccinated with such vector against infections by both the native CoV-HKU1 and the variant. Attenuated and replication-defective viruses may be of use for vaccination purposes with live vaccines as has been suggested for other viruses.

In accordance with the present invention the heterologous sequence to be incorporated into the viral vectors encoding the recombinant or chimeric viruses of the invention include sequences obtained or derived from different strains or variants of CoV-HKU1.

In certain embodiments, the chimeric or recombinant viruses of the invention are encoded by viral vectors derived from viral genomes wherein one or more sequences, intergenic regions, termini sequences, or portions or entire ORF have been substituted with a heterologous or non-native sequence. In certain embodiments of the invention, the chimeric viruses of the invention are encoded by viral vectors derived from viral genomes wherein one or more heterologous sequences have been inserted or added to the vector.

The selection of the viral vector may depend on the species of the subject that is to be treated or protected from a viral infection.

In accordance with the present invention, the viral vectors can be engineered to provide antigenic sequences which confer protection against infection by the CoV-HKU1 and natural variants thereof. The viral vectors may be engineered to provide one, two, three or more antigenic sequences. In accordance with the present invention the antigenic sequences may be derived from the same virus, from different strains or variants of the same type of virus, or from different viruses.

The expression products and/or recombinant or chimeric virions obtained in accordance with the invention may advantageously be utilized in vaccine formulations. The expression products and chimeric virions of the present invention may be engineered to create vaccines against a broad range of pathogens, including viral and bacterial antigens, tumor antigens, allergen antigens, and auto antigens involved in autoimmune disorders. In particular, the chimeric virions of the present invention may be engineered to create vaccines for the protection of a subject from infections with CoV-HKU1 and variants thereof.

In certain embodiments, the expression products and recombinant or chimeric virions of the present invention may be engineered to create vaccines against a broad range of pathogens, including viral antigens, tumor antigens and autoantigens involved in autoimmune disorders. One way to achieve this goal involves modifying existing CoV-HKU1 genes to contain foreign sequences in their respective external domains. Where the heterologous sequences are epitopes or antigens of pathogens, these chimeric viruses may be used to induce a protective immune response against the disease agent from which these determinants are derived.

Thus, the present invention relates to the use of viral vectors and recombinant or chimeric viruses to formulate vaccines against a broad range of viruses and/or antigens. The present invention also encompasses recombinant viruses comprising a viral vector derived from the CoV-HKU1 or variants thereof which contains sequences which result in a virus having a phenotype more suitable for use in vaccine formulations. The mutations and modifications can be in coding regions, in intergenic regions and in the leader and trailer sequences of the virus.

The invention provides a host cell comprising a nucleic acid or a vector according to the invention. Plasmid or viral vectors containing the polymerase components of CoV-HKU1 are generated in prokaryotic cells for the expression of the components in relevant cell types (bacteria, insect cells, eukaryotic cells). Plasmid or viral vectors containing full-length or partial copies of the CoV-HKU1 genome will be generated in prokaryotic cells for the expression of viral nucleic acids in-vitro or in-vivo. The latter vectors may contain other viral sequences for the generation of chimeric viruses or chimeric virus proteins, may lack parts of the viral genome for the generation of replication defective virus, and may contain mutations, deletions or insertions for the generation of attenuated viruses.

In addition, eukaryotic cells, transiently or stably expressing one or more full-length or partial CoV-HKU1 proteins can be used. Such cells can be made by transfection (proteins or nucleic acid vectors), infection (viral vectors) or transduction (viral vectors) and may be useful for complementation of mentioned wild type, attenuated, replication-defective or chimeric viruses.

The viral vectors and chimeric viruses of the present invention may be used to modulate a subject's immune system by stimulating a humoral immune response, a cellular immune response or by stimulating tolerance to an antigen. As used herein, a subject means: humans, primates, horses, cows, sheep, pigs, goats, dogs, cats, avian species and rodents.

5.2 Formulation of Vaccines and Antivirals

In a preferred embodiment, the invention provides a proteinaceous molecule or CoV-HKU1 specific viral protein or functional fragment thereof encoded by a nucleic acid according to the invention. Useful proteinaceous molecules are for example derived from any of the genes or genomic fragments derivable from the virus according to the invention, including envelop protein (E protein), integral membrane protein (M protein), spike protein (S protein), nucleocapsid protein (N protein), hemagglutinin esterase (HE protein), and RNA-dependent RNA polymerase. Such molecules, or antigenic fragments thereof, as provided herein, are for example useful in diagnostic methods or kits and in pharmaceutical compositions such as subunit vaccines. Particularly useful are polypeptides encoded by the nucleotide sequence of SEQ ID NO:1 or 3, including the polypeptides having the amino acid sequences of SEQ ID NOS:34-2918 in FIGS. 2 and 8, or SEQ ID NO:2, or antigenic fragments thereof for inclusion as antigen or subunit immunogen, but inactivated whole virus can also be used. Particularly useful are also those proteinaceous substances that are encoded by recombinant nucleic acid fragments of the CoV-HKU1 genome; of course preferred are those that are within the preferred bounds and metes of ORFs, in particular, for eliciting CoV-HKU1 specific antibody or T cell responses, whether in vivo (e.g. for protective or therapeutic purposes or for providing diagnostic antibodies) or in vitro (e.g. by phage display technology or another technique useful for generating synthetic antibodies).

The invention provides vaccine formulations for the prevention and treatment of infections with CoV-HKU1. In certain embodiments, the vaccine of the invention comprises recombinant and chimeric viruses of the CoV-HKU1.

In another aspect, the present invention also provides DNA vaccine formulations comprising a nucleic acid or fragment of the CoV-HKU1, or nucleic acid molecules having the sequence of SEQ ID NO:1 or 3, or a fragment thereof. In another specific embodiment, the DNA vaccine formulations of the present invention comprises a nucleic acid or fragment thereof encoding the antibodies which immunospecifically binds CoV-HKU1. In DNA vaccine formulations, a vaccine DNA comprises a viral vector, such as that derived from the CoV-HKU1, bacterial plasmid, or other expression vector, bearing an insert comprising a nucleic acid molecule of the present invention operably linked to one or more control elements, thereby allowing expression of the vaccinating proteins encoded by said nucleic acid molecule in a vaccinated subject. Such vectors can be prepared by recombinant DNA technology as recombinant or chimeric viral vectors carrying a nucleic acid molecule of the present invention.

Various heterologous vectors are described for DNA vaccinations against viral infections. For example, the vectors described in the following references may be used to express CoV-HKU1 sequences instead of the sequences of the viruses or other pathogens described; in particular, vectors described for hepatitis B virus (Michel, M. L. et al., 1995, DAN-mediated immunization to the hepatitis B surface antigen in mice: Aspects of the humoral response mimic hepatitis B viral infection in humans, *Proc. Natl. Aca. Sci. USA* 92:5307-5311; Davis, H. L. et al., 1993, DNA-based immunization induces continuous seretion of hepatitis B surface antigen and high levels of circulating antibody, *Human Molec. Genetics* 2:1847-1851), HIV virus (Wang, B. et al., 1993, *Gene inoculation generates immune responses against human immunodeficiency virus type 1, Proc. Natl. Acad. Sci. USA* 90:4156-4160; Lu, S. et al., 1996, Simian immunodeficiency virus DNA vaccine trial in macques, *J. Virol.* 70:3978-3991; Letvin, N. L. et al., 1997, Potent, protective anti-HIV immune responses generated by bimodal HIV envelope DNA plus protein vaccination, *Proc Natl Acad Sci USA.* 94(17):9378-83), and influenza viruses (Robinson, H L et al., 1993, Protection against a lethal influenza virus challenge by immunization with a haemagglutinin-expressing plasmid DNA, *Vaccine* 11:957-960; Ulmer, J. B. et al., Heterologous protection against influenza by injection of DNA encoding a viral protein, *Science* 259:1745-1749), as well as bacterial infections, such as tuberculosis (Tascon, R. E. et al., 1996, Vaccination against tuberculosis by DNA injection, *Nature Med.* 2:888-892; Huygen, K. et al., 1996, Immunogenicity and protective efficacy of a tuberculosis DNA vaccine, *Nature Med.,* 2:893-898), and parasitic infection, such as malaria (Sedegah, M., 1994, Protection against malaria by immunization with plasmid DNA encoding circumsporozoite protein, *Proc. Natl. Acad. Sci. USA* 91:9866-9870; Doolan, D. L. et al., 1996, Circumventing genetic restriction of protection against malaria with multigene DNA immunization: CD8+ T cell-interferon δ, and nitric oxide-dependent immunity, *J. Exper. Med.,* 1183:1739-1746).

Many methods may be used to introduce the vaccine formulations described above. These include, but are not limited to, oral, intradermal, intramuscular, intraperitoneal, intravenous, subcutaneous, and intranasal routes. Alternatively, it may be preferable to introduce the chimeric virus vaccine formulation via the natural route of infection of the pathogen for which the vaccine is designed. The DNA vaccines of the present invention may be administered in saline solutions by injections into muscle or skin using a syringe and needle (Wolff J. A. et al., 1990, Direct gene transfer into mouse muscle in vivo, *Science* 247:1465-1468; Raz, E., 1994, Intradermal gene immunization: The possible role of DNA uptake in the induction of cellular immunity to viruses, *Proc. Natl. Acad. Sci. USA* 91:9519-9523). Another way to administer DNA vaccines is called "gene gun" method, whereby microscopic gold beads coated with the DNA molecules of interest is fired into the cells (Tang, D. et al., 1992, Genetic immunization is a simple method for eliciting an immune response, *Nature* 356:152-154). For general reviews of the methods for DNA vaccines, see Robinson, H. L., 1999, DNA vaccines: basic mechanism and immune responses (Review), *Int. J. Mol. Med.* 4(5):549-555; Barber, B., 1997, Introduction: Emerging vaccine strategies, *Seminars in Immunology* 9(5): 269-270; and Robinson, H. L. et al., 1997, DNA vaccines, *Seminars in Immunology* 9(5):271-283.

5.3 Adjuvants and Carrier Molecules

CoV-HKU1-associated antigens are administered with one or more adjuvants. In one embodiment, the CoV-HKU1-associated antigen is administered together with a mineral salt adjuvants or mineral salt gel adjuvant. Such mineral salt and mineral salt gel adjuvants include, but are not limited to, aluminum hydroxide (ALHYDROGEL, REHYDRAGEL), aluminum phosphate gel, aluminum hydroxyphosphate (ADJU-PHOS), and calcium phosphate.

In another embodiment, CoV-HKU1-associated antigen is administered with an immunostimulatory adjuvant. Such class of adjuvants, include, but are not limited to, cytokines (e.g., interleukin-2, interleukin-7, interleukin-12, granulocyte-macrophage colony stimulating factor (GM-CSF), interfereon-γ interleukin-1β (IL-1β), and IL-1β peptide or Sclavo Peptide), cytokine-containing liposomes, triterpenoid glycosides or saponins (e.g., QuilA and QS-21, also sold under the trademark STIMULON, ISCOPREP), Muramyl Dipeptide (MDP) derivatives, such as N-acetyl-muramyl-L-threonyl-D-isoglutamine (Threonyl-MDP, sold under the trademark TERMURTIDE), GMDP, N-acetyl-nor-muramyl-L-alanyl-D-isoglutamine, N-acetylmuramyl-L-alanyl-D-isoglutaminyl-L-alanine-2-(1'-2'-dipalmitoyl-sn-glycero-3-hydroxy phosphoryloxy)-ethylamine, muramyl tripeptide phosphatidylethanolamine (MTP-PE), unmethylated CpG dinucleotides and oligonucleotides, such as bacterial DNA and fragments thereof, LPS, monophosphoryl Lipid A (3D-MLA sold under the trademark MPL), and polyphosphazenes.

In another embodiment, the adjuvant used is a particular adjuvant, including, but not limited to, emulsions, e.g., Freund's Complete Adjuvant, Freund's Incomplete Adjuvant, squalene or squalane oil-in-water adjuvant formulations, such as SAF and MF59, e.g., prepared with block-copolymers, such as L-121 (polyoxypropylene/polyoxyetheylene) sold under the trademark PLURONIC L-121, Liposomes, Virosomes, cochleates, and immune stimulating complex, which is sold under the trademark ISCOM.

In another embodiment, a microparticular adjuvant is used. Microparticulare adjuvants include, but are not limited to biodegradable and biocompatible polyesters, homo- and copolymers of lactic acid (PLA) and glycolic acid (PGA), poly(lactide-co-glycolides) (PLGA) microparticles, polymers that self-associate into particulates (poloxamer particles), soluble polymers (polyphosphazenes), and virus-like particles (VLPs) such as recombinant protein particulates, e.g., hepatitis B surface antigen (HbsAg).

Yet another class of adjuvants that may be used include mucosal adjuvants, including but not limited to heat-labile enterotoxin from *Escherichia coli* (LT), cholera holotoxin (CT) and cholera Toxin B Subunit (CTB) from *Vibrio cholerae*, mutant toxins (e.g., LTK63 and LTR72), microparticles, and polymerized liposomes.

In other embodiments, any of the above classes of adjuvants may be used in combination with each other or with other adjuvants. For example, non-limiting examples of combination adjuvant preparations that can be used to administer the CoV-HKU1-associated antigens of the invention include liposomes containing immunostimulatory protein, cytokines, or T-cell and/or B-cell peptides, or microbes with or without entrapped IL-2 or microparticles containing enterotoxin. Other adjuvants known in the art are also included within the scope of the invention (see *Vaccine Design: The Subunit and Adjuvant Approach*, Chap. 7, Michael F. Powell and Mark J. Newman (eds.), Plenum Press, New York, 1995, which is incorporated herein in its entirety).

The effectiveness of an adjuvant may be determined by measuring the induction of antibodies directed against an immunogenic polypeptide containing a CoV-HKU1 polypeptide epitope, the antibodies resulting from administration of this polypeptide in vaccines which are also comprised of the various adjuvants.

The polypeptides may be formulated into the vaccine as neutral or salt forms. Pharmaceutically acceptable salts include the acid additional salts (formed with free amino groups of the peptide) and which are formed with inorganic acids, such as, for example, hydrochloric or phosphoric acids, or organic acids such as acetic, oxalic, tartaric, maleic, and the like. Salts formed with free carboxyl groups may also be derived from inorganic bases, such as, for example, sodium potassium, ammonium, calcium, or ferric hydroxides, and such organic bases as isopropylamine, trimethylamine, 2-ethylamino ethanol, histidine, procaine and the like.

The vaccines of the invention may be multivalent or univalent. Multivalent vaccines are made from recombinant viruses that direct the expression of more than one antigen.

Many methods may be used to introduce the vaccine formulations of the invention; these include but are not limited to oral, intradermal, intramuscular, intraperitoneal, intravenous, subcutaneous, intranasal routes, and via scarification (scratching through the top layers of skin, e.g., using a bifurcated needle).

The patient to which the vaccine is administered is preferably a mammal, most preferably a human, but can also be a non-human animal including but not limited to cows, horses, sheep, pigs, fowl (e.g., chickens), goats, cats, dogs, hamsters, mice and rats.

5.4 Preparation of Antibodies

Antibodies which specifically recognize a polypeptide of the invention, such as, but not limited to, polypeptides comprising the sequence of SEQ ID NO:2 or any of SEQ ID NOS: 34-2918 or CoV-HKU1 epitope, or antigen-binding fragments thereof, can be used for detecting, screening, and isolating the polypeptide of the invention or fragments thereof, or similar sequences that might encode similar enzymes from the other organisms. For example, in one specific embodiment, an antibody which immunospecifically binds CoV-HKU1 epitope, or a fragment thereof, can be used for various in vitro detection assays, including enzyme-linked immunosorbent assays (ELISA), radioimmunoassays, Western blot, etc., for the detection of a polypeptide of the invention or, preferably, CoV-HKU1, in samples, for example, a biological material, including cells, cell culture media (e.g., bacterial cell culture media, mammalian cell culture media, insect cell culture media, yeast cell culture media, etc.), blood, plasma, serum, tissues, sputum, naseopharyngeal aspirates, etc.

Antibodies specific for a polypeptide of the invention or any epitope of CoV-HKU1 may be generated by any suitable method known in the art. Polyclonal antibodies to an antigen-of-interest, for example, the CoV-HKU1 epitopes or polypeptides encoded by a nucleotide sequence of SEQ ID NO:1 or 3, including the polypeptides shown in FIG. 2 (SEQ ID NOS: 34-1318), FIG. 8 (SEQ ID NOS:1319-2918), as well as SEQ ID NO:2, can be produced by various procedures well known in the art. For example, an antigen can be administered to various host animals including, but not limited to, rabbits, mice, rats, etc., to induce the production of antisera containing polyclonal antibodies specific for the antigen. Various adjuvants may be used to increase the immunological response, depending on the host species, and include but are not limited to, Freund's (complete and incomplete) adjuvant, mineral gels such as aluminum hydroxide, surface active substances such as lysolecithin, pluronic polyols, polyanions, peptides, oil emulsions, keyhole limpet hemocyanins, dinitrophenol, and potentially useful adjuvants for humans such as BCG (Bacille Calmette-Guerin) and *Corynebacterium parvum*. Such adjuvants are also well known in the art (see Section 5.4, supra).

Monoclonal antibodies can be prepared using a wide variety of techniques known in the art including the use of hybridoma, recombinant, and phage display technologies, or a combination thereof. For example, monoclonal antibodies can be produced using hybridoma techniques including those known in the art and taught, for example, in Harlow et al., Antibodies: A Laboratory Manual, (Cold Spring Harbor Laboratory Press, 2nd ed. 1988); Hammerling, et al., in: Monoclonal Antibodies and T-Cell Hybridomas, pp. 563-681 (Elsevier, N.Y., 1981) (both of which are incorporated by reference in their entireties). The term "monoclonal antibody" as used herein is not limited to antibodies produced through hybridoma technology. The term "monoclonal antibody" refers to an antibody that is derived from a single clone, including any eukaryotic, prokaryotic, or phage clone, and not the method by which it is produced.

Methods for producing and screening for specific antibodies using hybridoma technology are routine and well known in the art. In a non-limiting example, mice can be immunized with an antigen of interest or a cell expressing such an antigen. Once an immune response is detected, e.g., antibodies specific for the antigen are detected in the mouse serum, the mouse spleen is harvested and splenocytes isolated. The splenocytes are then fused by well known techniques to any suitable myeloma cells. Hybridomas are selected and cloned by limiting dilution. The hybridoma clones are then assayed by methods known in the art for cells that secrete antibodies capable of binding the antigen. Ascites fluid, which generally contains high levels of antibodies, can be generated by inoculating mice intraperitoneally with positive hybridoma clones.

Antibody fragments which recognize specific epitopes may be generated by known techniques. For example, Fab and F(ab')$_2$ fragments may be produced by proteolytic cleavage of immunoglobulin molecules, using enzymes such as papain (to produce Fab fragments) or pepsin (to produce F(ab')$_2$ fragments). F(ab')$_2$ fragments contain the complete light chain, and the variable region, the CH1 region and the hinge region of the heavy chain.

The antibodies of the invention or fragments thereof can be also produced by any method known in the art for the synthesis of antibodies, in particular, by chemical synthesis or preferably, by recombinant expression techniques.

The nucleotide sequence encoding an antibody may be obtained from any information available to those skilled in the art (i.e., from Genbank, the literature, or by routine cloning and sequence analysis). If a clone containing a nucleic acid encoding a particular antibody or an epitope-binding fragment thereof is not available, but the sequence of the antibody molecule or epitope-binding fragment thereof is known, a nucleic acid encoding the immunoglobulin may be chemically synthesized or obtained from a suitable source (e.g., an antibody cDNA library, or a cDNA library generated from, or nucleic acid, preferably poly A+ RNA, isolated from any tissue or cells expressing the antibody, such as hybridoma cells selected to express an antibody) by PCR amplification using synthetic primers hybridizable to the 3' and 5' ends of the sequence or by cloning using an oligonucleotide probe specific for the particular gene sequence to identify, e.g., a cDNA clone from a cDNA library that encodes the antibody.

Amplified nucleic acids generated by PCR may then be cloned into replicable cloning vectors using any method well known in the art.

Once the nucleotide sequence of the antibody is determined, the nucleotide sequence of the antibody may be manipulated using methods well known in the art for the manipulation of nucleotide sequences, e.g., recombinant DNA techniques, site directed mutagenesis, PCR, etc. (see, for example, the techniques described in Sambrook et al., supra; and Ausubel et al., eds., 1998, Current Protocols in Molecular Biology, John Wiley & Sons, NY, which are both incorporated by reference herein in their entireties), to generate antibodies having a different amino acid sequence by, for example, introducing amino acid substitutions, deletions, and/or insertions into the epitope-binding domain regions of the antibodies or any portion of antibodies which may enhance or reduce biological activities of the antibodies.

Recombinant expression of an antibody requires construction of an expression vector containing a nucleotide sequence that encodes the antibody. Once a nucleotide sequence encoding an antibody molecule or a heavy or light chain of an antibody, or portion thereof has been obtained, the vector for the production of the antibody molecule may be produced by recombinant DNA technology using techniques well known in the art as discussed in the previous sections. Methods which are well known to those skilled in the art can be used to construct expression vectors containing antibody coding sequences and appropriate transcriptional and translational control signals. These methods include, for example, in vitro recombinant DNA techniques, synthetic techniques, and in vivo genetic recombination. The nucleotide sequence encoding the heavy-chain variable region, light-chain variable region, both the heavy-chain and light-chain variable regions, an epitope-binding fragment of the heavy- and/or light-chain variable region, or one or more complementarity determining regions (CDRs) of an antibody may be cloned into such a vector for expression. Thus-prepared expression vector can be then introduced into appropriate host cells for the expression of the antibody. Accordingly, the invention includes host cells containing a polynucleotide encoding an antibody specific for the polypeptides of the invention or fragments thereof.

The host cell may be co-transfected with two expression vectors of the invention, the first vector encoding a heavy chain derived polypeptide and the second vector encoding a light chain derived polypeptide. The two vectors may contain identical selectable markers which enable equal expression of heavy and light chain polypeptides or different selectable markers to ensure maintenance of both plasmids. Alternatively, a single vector may be used which encodes, and is capable of expressing, both heavy and light chain polypeptides. In such situations, the light chain should be placed before the heavy chain to avoid an excess of toxic free heavy chain (Proudfoot, Nature, 322:52, 1986; and Kohler, Proc. Natl. Acad. Sci. USA, 77:2 197, 1980). The coding sequences for the heavy and light chains may comprise cDNA or genomic DNA.

In another embodiment, antibodies can also be generated using various phage display methods known in the art. In phage display methods, functional antibody domains are displayed on the surface of phage particles which carry the polynucleotide sequences encoding them. In a particular embodiment, such phage can be utilized to display antigen binding domains, such as Fab and Fv or disulfide-bond stabilized Fv, expressed from a repertoire or combinatorial antibody library (e.g., human or murine). Phage expressing an antigen binding domain that binds the antigen of interest can be selected or identified with antigen, e.g., using labeled antigen or antigen bound or captured to a solid surface or bead. Phage used in these methods are typically filamentous phage, including fd and M13. The antigen binding domains are expressed as a recombinantly fused protein to either the phage gene III or gene VIII protein. Examples of phage display methods that can be used to make the immunoglobulins, or fragments thereof, of the present invention include those disclosed in Brinkman et al., J. Immunol. Methods, 182:41-50, 1995; Ames et al., J. Immunol. Methods, 184:177-186, 1995; Kettleborough et al., Eur. J. Immunol., 24:952-958, 1994; Persic et al., Gene, 187:9-18, 1997; Burton et al., Advances in Immunology, 57:191-280, 1994; PCT application No. PCT/GB91/01134; PCT publications WO 90/02809; WO 91/10737; WO 92/01047; WO 92/18619; WO 93/11236; WO 95/15982; WO 95/20401; and U.S. Pat. Nos. 5,698,426; 5,223,409; 5,403,484; 5,580,717; 5,427,908; 5,750,753; 5,821,047; 5,571,698; 5,427,908; 5,516,637; 5,780,225; 5,658,727; 5,733,743 and 5,969,108; each of which is incorporated herein by reference in its entirety.

As described in the above references, after phage selection, the antibody coding regions from the phage can be isolated and used to generate whole antibodies, including human antibodies, or any other desired fragments, and expressed in any desired host, including mammalian cells, insect cells, plant cells, yeast, and bacteria, e.g., as described in detail below. For example, techniques to recombinantly produce Fab, Fab' and F(ab)$_2$ fragments can also be employed using methods known in the art such as those disclosed in PCT publication WO 92/22324; Mullinax et al., BioTechniques, 12(6):864-869, 1992; and Sawai et al., AJRI, 34:26-34, 1995; and Better et al., Science, 240:1041-1043, 1988 (each of which is incorporated by reference in its entirety). Examples of techniques which can be used to produce single-chain Fvs and antibodies include those described in U.S. Pat. Nos. 4,946,778 and 5,258,498; Huston et al., Methods in Enzymology, 203:46-88, 1991; Shu et al., PNAS, 90:7995-7999, 1993; and Skerra et al., Science, 240:1038-1040, 1988.

Once an antibody molecule of the invention has been produced by any methods described above, it may then be purified by any method known in the art for purification of an immunoglobulin molecule, for example, by chromatography (e.g., ion exchange, affinity, particularly by affinity for the specific antigen after Protein A or Protein G purification, and sizing column chromatography), centrifugation, differential solubility, or by any other standard techniques for the purification of proteins. Further, the antibodies of the present invention or fragments thereof may be fused to heterologous polypeptide sequences described herein or otherwise known in the art to facilitate purification.

For some uses, including in vivo use of antibodies in humans and in vitro detection assays, it may be preferable to use chimeric, humanized, or human antibodies. A chimeric antibody is a molecule in which different portions of the antibody are derived from different animal species, such as antibodies having a variable region derived from a murine monoclonal antibody and a constant region derived from a human immunoglobulin. Methods for producing chimeric antibodies are known in the art. See e.g., Morrison, Science, 229:1202, 1985; Oi et al., BioTechniques, 4:214 1986; Gillies et al., J. Immunol. Methods, 125:191-202, 1989; U.S. Pat. Nos. 5,807,715; 4,816,567; and 4,816,397, which are incorporated herein by reference in their entireties. Humanized antibodies are antibody molecules from non-human species that bind the desired antigen having one or more complementarity determining regions (CDRs) from the non-human species and framework regions from a human immunoglobulin molecule. Often, framework residues in the human framework regions will be substituted with the corresponding residue from the CDR donor antibody to alter, preferably improve, antigen binding. These framework substitutions are identified by methods well known in the art, e.g., by modeling of the interactions of the CDR and framework residues to identify framework residues important for antigen binding and sequence comparison to identify unusual framework residues at particular positions. See, e.g., Queen et al., U.S. Pat. No. 5,585,089; Riechmann et al., Nature, 332:323, 1988, which are incorporated herein by reference in their entireties. Antibodies can be humanized using a variety of techniques known in the art including, for example, CDR-grafting (EP 239,400; PCT publication WO 91/09967; U.S. Pat. Nos. 5,225,539; 5,530,101 and 5,585,089), veneering or resurfacing (EP 592,106; EP 519,596; Padlan, Molecular Immunology, 28(4/5):489-498, 1991; Studnicka et al., Protein Engineering, 7(6):805-814, 1994; Roguska et al., Proc Natl. Acad. Sci. USA, 91:969-973, 1994), and chain shuffling (U.S. Pat. No. 5,565,332), all of which are hereby incorporated by reference in their entireties.

Completely human antibodies are particularly desirable for therapeutic treatment of human patients. Human antibodies can be made by a variety of methods known in the art including phage display methods described above using antibody libraries derived from human immunoglobulin sequences. See U.S. Pat. Nos. 4,444,887 and 4,716,111; and PCT publications WO 98/46645; WO 98/50433; WO 98/24893; WO 98/16654; WO 96/34096; WO 96/33735; and WO 91/10741, each of which is incorporated herein by reference in its entirety.

Human antibodies can also be produced using transgenic mice which are incapable of expressing functional endogenous immunoglobulins, but which can express human immunoglobulin genes. For an overview of this technology for producing human antibodies, see Lonberg and Huszar, Int. Rev. Immunol., 13:65-93, 1995. For a detailed discussion of this technology for producing human antibodies and human monoclonal antibodies and protocols for producing such antibodies, see, e.g., PCT publications WO 98/24893; WO 92/01047; WO 96/34096; WO 96/33735; European Patent No. 0 598 877; U.S. Pat. Nos. 5,413,923; 5,625,126; 5,633,425; 5,569,825; 5,661,016; 5,545,806; 5,814,318; 5,885,793; 5,916,771; and 5,939,598, which are incorporated by reference herein in their entireties. In addition, companies such as Abgenix, Inc. (Fremont, Calif.), Medarex (NJ) and Genpharm (San Jose, Calif.) can be engaged to provide human antibodies directed against a selected antigen using technology similar to that described above.

Completely human antibodies which recognize a selected epitope can be generated using a technique referred to as "guided selection." In this approach a selected non-human monoclonal antibody, e.g., a mouse antibody, is used to guide the selection of a completely human antibody recognizing the same epitope. (Jespers et al., Bio/technology, 12:899-903, 1988).

Antibodies fused or conjugated to heterologous polypeptides may be used in in vitro immunoassays and in purification methods (e.g., affinity chromatography) well known in the art. See e.g., PCT publication Number WO 93/21232; EP 439,095; Naramura et al., Immunol. Lett., 39:91-99, 1994; U.S. Pat. No. 5,474,981; Gillies et al., PNAS, 89:1428-1432, 1992; and Fell et al., J. Immunol., 146:2446-2452, 1991, which are incorporated herein by reference in their entireties.

Antibodies may also be attached to solid supports, which are particularly useful for immunoassays or purification of the polypeptides of the invention or fragments, derivatives, analogs, or variants thereof, or similar molecules having the similar enzymatic activities as the polypeptide of the invention. Such solid supports include, but are not limited to, glass, cellulose, polyacrylamide, nylon, polystyrene, polyvinyl chloride or polypropylene.

5.5 Pharmaceutical Compositions and Kits

The present invention encompasses pharmaceutical compositions comprising anti-viral agents of the present invention. In a specific embodiment, the anti-viral agent is an antibody which immunospecifically binds CoV-HKU1 or variants thereof, or any proteins derived therefrom. In another specific embodiment, the anti-viral agent is a polypeptide or nucleic acid molecule of the invention. The pharmaceutical compositions have utility as an anti-viral prophylactic agent and may be administered to a subject where the subject has been exposed or is expected to be exposed to a virus.

Various delivery systems are known and can be used to administer the pharmaceutical composition of the invention, e.g., encapsulation in liposomes, microparticles, microcapsules, recombinant cells capable of expressing the mutant viruses, receptor mediated endocytosis (see, e.g., Wu and Wu, 1987, J. Biol. Chem. 262:4429 4432). Methods of introduction include but are not limited to intradermal, intramuscular, intraperitoneal, intravenous, subcutaneous, intranasal, epidural, and oral routes. The compounds may be administered by any convenient route, for example by infusion or bolus injection, by absorption through epithelial or mucocutaneous linings (e.g., oral mucosa, rectal and intestinal mucosa, etc.) and may be administered together with other biologically active agents. Administration can be systemic or local. In a preferred embodiment, it may be desirable to introduce the pharmaceutical compositions of the invention into the lungs by any suitable route. Pulmonary administration can also be employed, e.g., by use of an inhaler or nebulizer, and formulation with an aerosolizing agent.

In a specific embodiment, it may be desirable to administer the pharmaceutical compositions of the invention locally to the area in need of treatment; this may be achieved by, for example, and not by way of limitation, local infusion during surgery, topical application, e.g., in conjunction with a wound dressing after surgery, by injection, by means of a catheter, by means of a suppository, by means of nasal spray, or by means of an implant, said implant being of a porous, non porous, or gelatinous material, including membranes, such as sialastic membranes, or fibers. In one embodiment, administration can be by direct injection at the site (or former site) infected tissues.

In another embodiment, the pharmaceutical composition can be delivered in a vesicle, in particular a liposome (see Langer, 1990, Science 249:1527-1533; Treat et al., in Liposomes in the Therapy of Infectious Disease and Cancer, Lopez Berestein and Fidler (eds.), Liss, New York, pp. 353-365 (1989); Lopez-Berestein, ibid., pp. 317-327; see generally ibid.).

In yet another embodiment, the pharmaceutical composition can be delivered in a controlled release system. In one embodiment, a pump may be used (see Langer, supra; Sefton, 1987, CRC Crit. Ref. Biomed. Eng. 14:201; Buchwald et al., 1980, Surgery 88:507; and Saudek et al., 1989, N. Engl. J. Med. 321:574). In another embodiment, polymeric materials can be used (see Medical Applications of Controlled Release, Langer and Wise (eds.), CRC Pres., Boca Raton, Fla. (1974); Controlled Drug Bioavailability, Drug Product Design and Performance, Smolen and Ball (eds.), Wiley, New York (1984); Ranger and Peppas, J. Macromol. Sci. Rev. Macromol. Chem. 23:61 (1983); see also Levy et al., 1985, Science 228:190; During et al., 1989, Ann. Neurol. 25:351; Howard et al., 1989, J. Neurosurg. 71:105). In yet another embodiment, a controlled release system can be placed in proximity of the composition's target, i.e., the lung, thus requiring only a fraction of the systemic dose (see, e.g., Goodson, in Medical Applications of Controlled Release, supra, vol. 2, pp. 115-138 (1984)).

Other controlled release systems are discussed in the review by Langer (Science 249:1527-1533 (1990)).

The pharmaceutical compositions of the present invention comprise a therapeutically effective amount of recombinant or chimeric CoV-HKU1, and a pharmaceutically acceptable carrier. In a specific embodiment, the term "pharmaceutically acceptable" means approved by a regulatory agency of the Federal or a state government or listed in the U.S. Pharmacopeia or other generally recognized pharmacopeia for use in animals, and more particularly in humans. The term "carrier" refers to a diluent, adjuvant, excipient, or vehicle with which the pharmaceutical composition is administered. Such pharmaceutical carriers can be sterile liquids, such as water and oils, including those of petroleum, animal, vegetable or synthetic origin, such as peanut oil, soybean oil, mineral oil, sesame oil and the like. Water is a preferred carrier when the pharmaceutical composition is administered intravenously. Saline solutions and aqueous dextrose and glycerol solutions can also be employed as liquid carriers, particularly for injectable solutions. Suitable pharmaceutical excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. The composition, if desired, can also contain minor amounts of wetting or emulsifying agents, or pH buffering agents. These compositions can take the form of solutions, suspensions, emulsion, tablets, pills, capsules, powders, sustained release formulations and the like. The composition can be formulated as a suppository, with traditional binders and carriers such as triglycerides. Oral formulation can include standard carriers such as pharmaceutical grades of mannitol, lactose, starch, magnesium stearate, sodium saccharine, cellulose, magnesium carbonate, etc. Examples of suitable pharmaceutical carriers are described in "Remington's Pharmaceutical Sciences" by E. W. Martin. The formulation should suit the mode of administration.

In a preferred embodiment, the composition is formulated in accordance with routine procedures as a pharmaceutical composition adapted for intravenous administration to human beings. Typically, compositions for intravenous administration are solutions in sterile isotonic aqueous buffer. Where necessary, the composition may also include a solubilizing agent and a local anesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the composition is to be administered by infusion, it can be dispensed with an infusion bottle containing sterile pharmaceutical grade water or saline. Where the composition is administered by injection, an ampoule of sterile water for injection or saline can be provided so that the ingredients may be mixed prior to administration.

The pharmaceutical compositions of the invention can be formulated as neutral or salt forms. Pharmaceutically acceptable salts include those formed with free amino groups such as those derived from hydrochloric, phosphoric, acetic, oxalic, tartaric acids, etc., and those formed with free carboxyl groups such as those derived from sodium, potassium, ammonium, calcium, ferric hydroxides, isopropylamine, triethylamine, 2 ethylamino ethanol, histidine, procaine, etc.

The amount of the pharmaceutical composition of the invention which will be effective in the treatment of a particular disorder or condition will depend on the nature of the disorder or condition, and can be determined by standard clinical techniques. In addition, in vitro assays may optionally be employed to help identify optimal dosage ranges. The precise dose to be employed in the formulation will also depend on the route of administration, and the seriousness of the disease or disorder, and should be decided according to the judgment of the practitioner and each patient's circumstances. However, suitable dosage ranges for intravenous administration are generally about 20-500 micrograms of active compound per kilogram body weight. Suitable dosage ranges for intranasal administration are generally about 0.01 pg/kg body weight to 1 mg/kg body weight. Effective doses may be extrapolated from dose response curves derived from in vitro or animal model test systems.

Suppositories generally contain active ingredient in the range of 0.5% to 10% by weight; oral formulations preferably contain 10% to 95% active ingredient.

The invention also provides a pharmaceutical pack or kit comprising one or more containers filled with one or more of the ingredients of the pharmaceutical compositions of the invention. Optionally associated with such container(s) can be a notice in the form prescribed by a governmental agency regulating the manufacture, use or sale of pharmaceuticals or biological products, which notice reflects approval by the agency of manufacture, use or sale for human administration. In a preferred embodiment, the kit contains an anti-viral agent of the invention, e.g., an antibody specific for the polypeptides encoded by a nucleotide sequence of SEQ ID NO:1 or 3, or any CoV-HKU1 epitope, or a polypeptide or protein of the present invention, including those shown in FIG. 2 (SEQ ID NOS:34-1318), FIG. 8 (SEQ ID NOS:1319-2918), and SEQ ID NO:2, or a nucleic acid molecule of the invention, alone or in combination with adjuvants, antivirals, antibiotics, analgesic, bronchodialaters, or other pharmaceutically acceptable excipients.

The present invention further encompasses kits comprising a container containing a pharmaceutical composition of the present invention and instructions for use.

5.6 Detection Assays

The present invention provides a method for detecting an antibody, which immunospecifically binds to the CoV-HKU1, in a biological sample, for example blood, serum, plasma, saliva, urine, etc., from a patient suffering from respiratory tract infection. In a specific embodiment, the method comprising contacting the sample with the polypeptides or protein encoded by the nucleotide sequence of SEQ ID NO:1 and/or 3, including the polypeptides having the amino acid sequences of SEQ ID NOS:34-1318 shown in FIG. 2, SEQ ID NOS:1319-2918 shown in FIG. 8, or SEQ ID NO:2, directly immobilized on a substrate and detecting the virus-bound antibody directly or indirectly by a labeled heterologous antiisotype antibody. In another specific embodiment, the sample is contacted with a host cell comprising a nucleic acid molecule having the nucleotide sequence of SEQ ID NO:1 or 3 and expressing the polypeptides encoded thereby, and the bound antibody can be detected by immunofluorescent assay.

An exemplary method for detecting the presence or absence of a polypeptide or nucleic acid of the invention in a biological sample involves obtaining a biological sample from various sources and contacting the sample with a compound or an agent capable of detecting an epitope or nucleic acid (e.g., mRNA, genomic RNA) of CoV-HKU1 such that the presence of CoV-HKU1 is detected in the sample. A preferred agent for detecting CoV-HKU1 mRNA or genomic RNA of the invention is a labeled nucleic acid probe capable of hybridizing to mRNA or genomic RNA encoding a polypeptide of the invention. The nucleic acid probe can be, for example, a nucleic acid molecule comprising or consisting of the nucleotide sequence of SEQ ID NO:1 or 3, or a portion thereof, or a complement thereof, such as an oligonucleotide of at least 15, 20, 25, 30, 50, 100, 250, 500, 750, 1,000 or more contiguous nucleotides in length and sufficient to specifically hybridize under stringent conditions to a CoV-HKU1 mRNA or genomic RNA.

In another preferred specific embodiment, the presence of CoV-HKU1 is detected in the sample by an reverse transcription polymerase chain reaction (RT-PCR) using the primers that are constructed based on a partial nucleotide sequence of the genome of CoV-HKU1 or a genomic nucleic acid sequence of SEQ ID NO:3, or based on a nucleotide sequence of SEQ ID NO:1. In a non-limiting specific embodiment, preferred primers to be used in a RT-PCR method are: 5'-GGTTGGGACTATCCTAAGTGTGA-3' (SEQ ID NO:4) and 5'-CCATCATCAGATAGAATCATCATA-3' (SEQ ID NO:5), in the presence of 3 mM $MgCl_2$ and the thermal cycles are, for example, but not limited to, 94° C. for 8 min followed by 40 cycles of 94° C. for 1 min, 50° C. for 1 min, 72° C. for 1 min. In more preferred specific embodiment, the present invention provides a real-time quantitative PCR assay to detect the presence of CoV-HKU1 in a biological sample by subjecting the cDNA obtained by reverse transcription of the extracted total RNA from the sample to PCR reactions using the specific primers, such as those having nucleotide sequences of SEQ ID NOS:4 and 5, and a fluorescence dye, such as SYBR® Green I, which fluoresces when bound nonspecifically to double-stranded DNA. The fluorescence signals from these reactions are captured at the end of extension steps as PCR product is generated over a range of the thermal cycles, thereby allowing the quantitative determination of the viral load in the sample based on an amplification plot.

A preferred agent for detecting CoV-HKU1 is an antibody that specifically binds a polypeptide of the invention or any CoV-HKU1 epitope, preferably an antibody with a detectable label. Antibodies can be polyclonal, or more preferably, monoclonal. An intact antibody, or a fragment thereof (e.g., Fab or F(ab')$_2$) can be used.

The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently labeled secondary antibody and end-labeling of a DNA probe with biotin such that it can be detected with fluorescently labeled streptavidin. The detection method of the invention can be used to detect mRNA, protein (or any epitope), or genomic RNA in a sample in vitro as well as in vivo. For example, in vitro techniques for detection of mRNA include northern hybridizations, in situ hybridizations, RT-PCR, and RNase protection. In vitro techniques for detection of an epitope of CoV-HKU1 include enzyme linked immunosorbent assays (ELISAs), Western blots, immunoprecipitations and immunofluorescence. In vitro techniques for detection of genomic RNA include northern hybridizations, RT-PCR, and RNase protection. Furthermore, in vivo techniques for detection of CoV-HKU1 include introducing into a subject organism a labeled antibody directed against the polypeptide. For example, the antibody can be labeled with a radioactive marker whose presence and location in the subject organism can be detected by standard imaging techniques, including autoradiography.

In a specific embodiment, the methods further involve obtaining a control sample from a control subject, contacting the control sample with a compound or agent capable of detecting CoV-HKU1, e.g., a polypeptide of the invention or mRNA or genomic RNA encoding a polypeptide of the invention, such that the presence of CoV-HKU1 or the polypeptide or mRNA or genomic RNA encoding the polypeptide is detected in the sample, and comparing the absence of CoV-HKU1 or the polypeptide or mRNA or genomic RNA encoding the polypeptide in the control sample with the presence of CoV-HKU1, or the polypeptide or mRNA or genomic DNA encoding the polypeptide in the test sample.

The invention also encompasses kits for detecting the presence of CoV-HKU1 or a polypeptide or nucleic acid of the invention in a test sample. The kit, for example, can comprise a labeled compound or agent capable of detecting CoV-HKU1 or the polypeptide or a nucleic acid molecule encoding the polypeptide in a test sample and, in certain embodiments, a means for determining the amount of the polypeptide or mRNA in the sample (e.g., an antibody which binds the polypeptide or an oligonucleotide probe which binds to DNA or mRNA encoding the polypeptide). Kits can also include instructions for use.

For antibody-based kits, the kit can comprise, for example: (1) a first antibody (e.g., attached to a solid support) which binds to a polypeptide of the invention or CoV-HKU1 epitope; and, optionally, (2) a second, different antibody which binds to either the polypeptide or the first antibody and is conjugated to a detectable agent.

For oligonucleotide-based kits, the kit can comprise, for example: (1) an oligonucleotide, e.g., a detectably labeled oligonucleotide, which hybridizes to a nucleic acid sequence encoding a polypeptide of the invention or to a sequence within the CoV-HKU1 genome or (2) a pair of primers useful for amplifying a nucleic acid molecule containing an CoV-HKU1 sequence. The kit can also comprise, e.g., a buffering agent, a preservative, or a protein stabilizing agent. The kit can also comprise components necessary for detecting the detectable agent (e.g., an enzyme or a substrate). The kit can also contain a control sample or a series of control samples which can be assayed and compared to the test sample contained. Each component of the kit is usually enclosed within an individual container and all of the various containers are within a single package along with instructions for use.

6. EXAMPLES

The following examples illustrate the identification of the novel CoV-HKU1. These examples should not be construed as limiting.

Methods and Results

As a general reference, Wiedbrauk D L & Johnston S L G. (Manual of Clinical Virology, Raven Press, New York, 1993) was used.

6.1 Clinical Subject

The patient is an in-patient of the United Christian Hospital in Hong Kong. Nasopharyngeal aspirates were collected from the patient weekly from the first till the fifth week of the illness, stool and urine in the first and second week of the illness, and sera in the first, second, and fourth weeks of the illness.

6.2 Antibody Detection

To produce a fusion plasmid for protein purification, primers, 5'-TTTTCCTTTT GCGGCCGCTTAAGCAACA-GAGTCTTCTA-3' (SEQ ID NO:6) and 5'-CGGAATTC GATGTCTTATACTCCCGGT-3'(SEQ ID NO:7) were used to amplify the gene encoding the N protein of the CoV-HKU1 by RT-PCR. The sequence coding for amino acid residues 1 to 441 of the N protein was amplified and cloned into the EcoRI and NotI sites of expression vector pET-28b(+) (Novagen, Madison, Wis., USA) in frame and downstream of the series of six histidine residues. The $(His)_6$-tagged (SEQ ID NO:27) recombinant N protein was expressed in E. coli and purified using the $Ni^{2+}$-loaded HiTrap Chelating System (Amersham Pharmacia, USA) according to the manufacturer's instructions.

Western blot analysis was performed as follows: Two-hundred ng of purified $(His)_6$-tagged (SEQ ID NO:27) recombinant N protein of CoV-HKU1 were loaded into each well of a sodium dodecyl sulfate (SDS)-10% polyacrylamide gel and subsequently electroblotted onto a nitrocellulose membrane (Bio-Rad, Hercules, Calif., USA). The blot was cut into strips and the strips were incubated separately with 1:2000 dilution of serum samples obtained during the first, second, and fourth weeks of the patient's illness. Serum samples of two healthy blood donors were used as controls. Antigen-antibody interaction was detected with an ECL fluorescence system (Amersham Life Science, Buckinghamshire, UK).

Several prominent immunoreactive bands were visible for serum samples collected during the second and fourth weeks of the patient's illness (FIG. 7, lanes 2 and 3). The sizes of the largest bands were about 53 kDa, consistent with the expected size of 52.8 kDa for the full-length $(His)_6$-tagged (SEQ ID NO:27) N protein, whereas the other bands were consistent with the degradation products of the $(His)_6$-tagged (SEQ ID NO:27) N protein. Only very faint bands were observed for serum samples obtained from the patient during the first week of the illness (FIG. 7, lane 1) and two healthy blood donors (FIG. 7, lanes 4 and 5).

ELISA was performed using the recombinant N protein of CoV-HKU1 prepared as described above. Each well of a Nunc immunoplate (Roskilde, Denmark) was coated with 20 ng of purified $(His)_6$-tagged (SEQ ID NO:27) recombinant N protein for 12 h and then blocked in phosphate-buffered saline with 2% bovine serum albumin. The serum samples obtained from the patient during the first, second, and fourth weeks of the illness were serially diluted and were added to the wells of the $(His)_6$-tagged (SEQ ID NO:27) recombinant N protein-coated plates in a total volume of 100 µl per well and incubated at 37° C. for 2 h. After washing with washing buffer five times, 100 µl per well of 1:4000 diluted horse radish peroxidase-conjugated goat anti-human IgG antibody (Zymed Laboratories Inc., South San Francisco, Calif., USA) were added to the wells and incubated at 37° C. for 1 h. After washing with washing buffer five times, 100 µl of diluted 3,3',5,5'-tetramethylbenzidine (Zymed Laboratories Inc.) were added to each well and incubated at room temperature for 15 min. One hundred microliters of 0.3 M $H_2SO_4$ were added and the absorbance at 450 nm of each well was measured. Each sample was tested in duplicate and the mean absorbance for each serum was calculated.

Box titration was carried out with different dilutions of $(His)_6$-tagged (SEQ ID NO:27) recombinant N protein coating antigen and serum obtained from the fourth week of the patient's illness. The results identified 20 ng and 80 ng of purified $(His)_6$-tagged recombinant N protein per ELISA well as the ideal amount for plate coating and 1:1000 and 1:20 as the most optimal serum dilution for IgG and IgM detection, respectively.

To establish the baseline for the tests, serum samples (diluted at 1:1000 and 1:20 for IgG and IgM, respectively) from 100 healthy blood donors were tested in the CoV-HKU1 antibody ELISA. For the 100 sera from healthy blood donors, the mean ELISA $OD_{450}$ values for IgG and IgM detection were 0.178 and 0.224, with standard deviations of 0.070 and 0.117. Absorbance values of 0.387 and 0.576 were selected as the cutoff values (that equal the sum of the mean value from the healthy control and three times the standard deviation) for IgG and IgM, respectively. Using these cutoff values, the titers for IgG of the patient's serum samples obtained during the first, second, and fourth weeks of the illness were <1:1000, 1:2000, and 1:8000, respectively (FIG. 6), and those for IgM were 1:20, 1:40, and 1:80, respectively (data not shown).

6.3 RT-PCR and Real Time Quantitative PCR

RT-PCR Assay

An RT-PCR was developed to detect the CoV-HKU1 sequence from NPA samples. Total RNA from clinical samples was reverse transcribed using random hexamers and cDNA was amplified using primers 5'-GGTTGGGACTATC-CTAAGTGTGA-3' (SEQ ID NO:4) and 5'-CCATCATCA-GATAGAATCATCATA-3' (SEQ ID NO:5), which were constructed based on the RNA-dependent RNA polymerase-encoding sequence (SEQ ID NO:1) of the CoV-HKU1 in the presence of 2.5 mM $MgCl_2$ (94° C. for 8 min followed by 40 cycles of 94° C. for 1 min, 50° C. for 1 min, 72° C. for 1 min).

The summary of a typical RT-PCR protocol is as follows:

1. RNA Extraction

RNA from 140 µl of NPA samples was extracted by QIAquick® viral RNA extraction kit and was eluted in 50 µl of elution buffer.

2. Reverse Transcription

| RNA | 11.5 µl |
|---|---|
| 0.1 M DTT | 2 µl |
| 5× buffer | 4 µl |
| 10 mM dNTP | 1 µl |
| Superscript II, 200 U/µl (Invitrogen) | 1 µl |
| Random hexamers, 0.3 µg/µl | 0.5 µl |
| Reaction condition | 42° C., 50 min |
|  | 94° C., 3 min |
|  | 4° C. |

3. PCR cDNA generated by random primers was amplified in a 50 µl reaction as follows:

| cDNA | 2 µl |
|---|---|
| 10 mM dNTP | 0.5 µl |
| 10× buffer | 5 µl |
| 25 mM $MgCl_2$ | 5 µl |
| 25 µM Forward primer | 0.5 µl |
| 25 µM Reverse primer | 0.5 µl |
| AmpliTaq Gold ® polymerase, 5 U/µl (Applied Biosystems) | 0.25 µl |
| Water | 36.25 µl |

Thermal-cycle condition: 95° C., 10 min, followed by 40 cycles of 95° C., 1 min; 50° C. 1 min; 72° C., 1 min.

4. Primer Sequences

Primers were designed based on the RNA-dependent RNA polymerase encoding sequence (SEQ ID NO:1) of the CoV-HKU1.

Forward primer: 5'-GGTTGGGACTATCCTAAGT-GTGA-3' (SEQ ID NO:4)

Reverse primer: and 5'-CCATCATCAGATAGAATCAT-CATA-3' (SEQ ID NO:5)

Product size: 440 bps

Real-Time Quantitative PCR Assay

Total RNA from 140 μl of nasopharyngeal aspirate (NPA) was extracted by QIAamp® virus RNA mini kit (Qiagen) as instructed by the manufacturer. Ten μl of eluted RNA samples were reverse transcribed by 200 U of Superscript® II reverse transcriptase (Invitrogen) in a 20 μl reaction mixture containing 0.15 μg of random hexamers, 10 mmol/L DTT, and 0.5 mmol/L dNTP, as instructed. Complementary DNA was then amplified in a SYBR® Green I fluorescence reaction (Roche, Ind.) mixtures. Briefly, 20 μl reaction mixtures containing 2 μl of cDNA, 3.5 mmol/L $MgCl_2$, 0.25 μmol/L of forward primer [5'-GGTTGGGACTATCCTAAGTGTGA-3' (SEQ ID NO:4)] and 0.25 μmol/L reverse primer [5'-CCATCATCA-GATAGAATCATCATA-3' (SEQ ID NO:5)] were thermal-cycled by a LightCycler® (Roche) with the PCR program, [95° C., 10 min followed by 50 cycles of 95° C., 10 min; 57° C., 5 sec; 72° C. 9 sec]. Plasmids containing the target sequence were used as positive controls. Fluorescence signals from these reactions were captured at the end of extension step in each cycle. To determine the specificity of the assay, PCR products (440 base pairs) were subjected to a melting curve analysis at the end of the assay (65° C. to 95° C., 0.1° C. per second) (data not shown).

The amount of CoV-HKU1 RNA in the nasopharyngeal aspirates was followed weekly. Quantitative RT-PCR showed that the amounts of CoV-HKU1 RNA were $8.5 \times 10^5$ and $9.6 \times 10^6$ copies per ml in two nasopharyngeal aspirates collected in the first week of the illness, $1.5 \times 10^5$ copies per ml of NPA, respectively, at two time points collected in the second week of the illness, but CoV-HKU1 RNA was undetectable in the NPA collected in the third, fourth and fifth weeks of the illness (FIG. 6). CoV-HKU1 RNA was also undetectable in the urine and stool of the patient collected in the first and second weeks of the illness.

Discussion

The genome of CoV-HKU1 is a 29942-nucleotide long, polyadenylated RNA. The G+C content is 32%, which is the lowest among all known coronaviruses with genome sequences available, with a GC skew of 0.19. Table 1 shows the comparison of genomic features of CoV-HKU1 and other corona viruses.

TABLE 1

| Coronaviruses | Genome features | | |
|---|---|---|---|
| | Size (bases) | G + C content | GC skew |
| Group 1 | | | |
| HCoV-229E | 27317 | 0.38 | 0.13 |
| PEDV | 28033 | 0.42 | 0.09 |
| HCoV-NL63 | 27553 | 0.34 | 0.16 |
| Group 2 | | | |
| CoV-HKU1 | 29942 | 0.32 | 0.19 |
| HCoV-OC43 | 30738 | 0.37 | 0.18 |
| BcoV | 31028 | 0.37 | 0.17 |
| MHV | 31357 | 0.42 | 0.14 |

TABLE 1-continued

| Coronaviruses | Genome features | | |
|---|---|---|---|
| | Size (bases) | G + C content | GC skew |
| Group 3 | | | |
| IBV | 27608 | 0.38 | 0.14 |
| SARS-CoV | 29751 | 0.41 | 0.02 |

HCoV-229E=human coronavirus 229E; PEDV=porcine epidemic diarrhea virus; HCoV-NL63=human coronavirus NL63; HCoV-OC43=human coronavirus OC43; MHV=murine hepatitis virus; BCoV=bovine coronavirus; IBV=infectious bronchitis virus; SARS-CoV=SARS coronavirus; GC skew=(G−C)/(G+C)

The genome organization is the same as other coronaviruses, with the characteristic gene order 5'-replicase, S, E, M, N-3'. Both 5' and 3' ends contain short untranslated regions. The 5' end of the genome consists of a putative 5' leader sequence. A putative transcription regulatory sequences (TRS) motif, 5'-CUAAAC-3', was found at the 3' end of the leader sequence and precedes each translated ORF except ORF5 which encodes the putative E protein. Table 2 shows the putative transcription regulatory sequences in the genome of CoV-HKU1.

TABLE 2

| Number of base upstream of AUG | ORF | TRS sequence | SEQ ID NO. |
|---|---|---|---|
| −140 | Leader | UUAAAU<u>CUAAAC</u>UUUUUAA (127) AUG | 8 |
| −7 | Hemagglutinin-esterase | UUAAAU<u>CUAAAC</u>UAUG | 9 |
| −6 | Spike | UUAAAU<u>CUAAAC</u>AUG | 10 |
| −13 | ORF4 | UUAAAU<u>CUAAAC</u>UUUAUUUAUG | 11 |
| −9 | Membrane | CUAAAU<u>CUAAAC</u>AUUAUG | 12 |
| −13 | Nucleocapsid | UUAAAU<u>CUAAAC</u>UAUUAGGAUG | 13 |
| −35 | ORF8 | UUAAAU<u>CUAAAC</u>UAUUAGGAUG UCUUAUACUCCCGGUCAUUAUG | 14 |

As in SDAV (Sialodacryoadenitis virus) and MHV (mouse hepatitis virus), ORF5 may share the same TRS with ORF4, suggesting that the translation of the E protein is cap-independent, possibly via an internal ribosomal entry site. The 3' untranslated region contains a predicted pseudoknot structure 59-119 bp downstream of N gene. This pseudoknot structure is highly conserved among coronaviruses and plays a role in coronavirus RNA replication.

The coding potential of the CoV-HKU1 genome is shown in FIG. 3 and Table 3 and the phylogenetic analyses of the chymotrypsin-like protease ($3CL^{pro}$), replicase, helicase, haemagglutinin-esterase (HE), S, E, M and N, are shown in FIGS. 4A and 4B.

TABLE 3

| ORFs | Start-end (base) | No. of bases | No. of amino acids | Frame | Candidate TRS |
|---|---|---|---|---|---|
| ORF 1a | 206-13600 | 13395 | 4465 | +2 | — |
| ORF 1b | 13600-21753 | 8154 | 2717 | +1 | — |
| HE (ORF 2) | 21773-22933 | 1161 | 386 | +2 | Strong |
| S (ORF 3) | 22942-27012 | 4071 | 1356 | +1 | Strong |
| ORF 4 | 27051-27380 | 330 | 109 | +3 | Strong |
| E (ORF 5) | 27373-27621 | 249 | 82 | +1 | None |
| M (ORF 6) | 27633-28304 | 672 | 223 | +3 | Strong |
| N (ORF 7) | 28320-29645 | 1326 | 441 | +3 | Strong |
| ORF8 | 28342-28959 | 618 | 205 | +1 | Strong |

The replicase 1a ORF (bases 206-13600) and replicase 1b ORF (bases 13600-21753) occupy 21.5 kb of the CoV-HKU1 genome. Similar to other coronaviruses, a frame shift interrupts the protein-coding regions and separates the 1a and 1b ORFs. This ORF encodes a number of putative proteins, including papain-like protease (PLP) with two copies of the PLP domain, PLP1$^{pro}$ and PLP2$^{pro}$, 3CL$^{pro}$, replicase, helicase, and other proteins of unknown functions. These proteins are produced by proteolytic cleavages of a large polyprotein (FIG. 3). The sequence of the resulting putative proteins is the same as that in the MHV genome. This polyprotein is synthesized by a −1 ribosomal frameshift at a conserved site (UUUAAAC) upstream of a pseudoknot structure at the junction of ORF 1a and ORF 1b. This ribosomal frameshift would result in a polyprotein of 7182 amino acids, which has 75-77% amino acid identities with the polyprotein in other Group 2 coronaviruses and 43-47% amino acid identities with the polyprotein in other non-Group 2 coronaviruses. The replicase gene of CoV-HKU1, which encodes 928 amino acids, has 87-89% amino acid identities with the replicase of other Group 2 coronaviruses and 54-65% amino acid identities with the replicase of other non-Group 2 coronaviruses (Table 4 and FIG. 4A). Table 4 shows amino acid identities between the predicted chymotrypsin-like protease (3CL$^{pro}$), replicase (Rep), helicase (Hel), hemagglutinin-esterase (HE), spike (S), envelope (E), membrane (M), and nucleocapsid (N) proteins of CoV-HKU1 and the corresponding proteins of other coronaviruses.

TABLE 4

| Group | Virus | Pairwise amino acid identity (%) | | | | | | | |
|---|---|---|---|---|---|---|---|---|---|
| | | 3CL$^{pro}$ | Rep | Hel | HE | S | E | M | N |
| 1 | HCoV-229E | 45 | 54 | 55 | — | 31 | 26 | 35 | 28 |
| | PEDV | 44 | 56 | 55 | — | 30 | 34 | 37 | 37 |
| | PTGV | 45 | 57 | 57 | — | 32 | 34 | 37 | 27 |
| | CCoV | — | — | — | — | 31 | 32 | 36 | 27 |
| | HCoV-NL63 | 43 | 54 | 54 | — | 30 | 28 | 32 | 28 |
| 2 | HCoV-OC43 | 82 | 87 | 88 | 57 | 60 | 54 | 76 | 58 |
| | MHV | 85 | 89 | 87 | 50 | 58 | 55 | 78 | 60 |
| | BCoV | 84 | 88 | 88 | 56 | 61 | 55 | 76 | 57 |
| | SDAV | — | — | — | 50 | 61 | 60 | 77 | 62 |
| | ECoV | — | — | — | 53 | 61 | 56 | 78 | 59 |
| | PHEV | — | — | — | 54 | 61 | 54 | 77 | 57 |
| 3 | IBV | 41 | 60 | 57 | — | 32 | 28 | 38 | 27 |
| SARS-CoV | SARS-CoV | 48 | 65 | 63 | — | 33 | 27 | 34 | 31 |

HCoV-229E=human coronavirus 229E; PEDV=porcine epidemic diarrhea virus; PTGV=porcine transmissible gastroenteritis virus; CCoV=canine enteric coronavirus; HCoV-NL63=human coronavirus NL63; HCoV-OC43=human coronavirus OC43; MHV=murine hepatitis virus; BCoV=bovine coronavirus; SDAV=rat sialodacryoadenitis coronavirus; ECoV=equine coronavirus NC99; PHEV=porcine hemagglutinating encephalomyelitis virus; IBV=infectious bronchitis virus; SARS-CoV=SARS coronavirus The catalytic histidine and cysteine amino acid residues, conserved among the 3CL$^{pro}$ in all coronaviruses, are present in the predicted 3CL$^{pro}$ of CoV-HKU1 (amino acids His$^{3375}$ and Cys$^{3479}$ of ORF 1 a). In the N-terminal of the putative PLP (amino acid residues 945 to 1104 of ORF 1a), there are 14 tandem copies of a 30-base repeat, which encode NDDEDVVTGD (SEQ ID NO:15), followed by two 30-base regions that encode NNDEEIVTGD (SEQ ID NO:16) and NDDQIVVTGD (SEQ ID NO:17), located upstream to the first copy of PLP domain, PLP1$^{pro}$. This repeat is not observed in other coronaviruses.

ORF 2 (bases 21773-22933) encodes the predicted HE glycoprotein with 386 amino acids. The HE protein of CoV-HKU1 has 50-57% amino acid identities with the HE proteins of other Group 2 coronaviruses (Table 4 and FIG. 4A). PFAM and InterProScan analyses of the ORF show that amino acid residues 1 to 349 of the predicted protein is a member of the haemagglutinin esterase family (PFAM accession no.: PF03996 and INTERPRO accession no. IPR007142). This family contains membrane glycoproteins that are present on viral surface and are involved with the cell infection process. It contains haemagglutinin chain 1 (HE1) and haemagglutinin chain 2 (HE2), and forms a homotrimer with each monomer being formed by two chains linked by a disulphide bond. Furthermore, PFAM and InterProScan analyses of the ORF show that amino acid residues 122 to 236 of the predicted protein are the haemagglutinin domain of HE-fusion glycoprotein family (PFAM accession no.: PF02710 and INTERPRO accession no. IPR003860). HE is also present in other Group 2 coronaviruses and influenza C virus. SignalP analysis reveals a signal peptide probability of 0.738, with a cleavage site between residues 13 and 14. Although TMpred and TMHMM analyses of the ORF show four and three transmembrane domains, respectively, PHDhtm analysis of the ORF shows only one transmembrane domain at positions 354 to 376. This concurs with only one transmembrane region reported in the C terminal of the HE of BCoV (bovine coronavirus) and puffinosis virus. PrositeScan analysis of the HE protein of CoV-HKU1 reveals eight potential N-linked glycosylation (six NXS and two NXT) sites. These are located at positions 83 (NYT), 110, (NGS), 145 (NVS), 168 (NYS), 193 (NFS), 286 (NSS), 314 (NVS, and 328 (NFT). The putative active site for neuraminate O-acetyl-esterase activity, FGDS (SEQ ID NO:18), is located at positions 31-34.

ORF 3 (bases 22942-27012) encodes the predicted S glycoprotein (PFAM accession no. PF01601) with 1356 amino acids. The S protein of CoV-HKU1 has 58-61% amino acid identities with the S proteins of other Group 2 coronaviruses, but has fewer than 35% amino acid identities with the S proteins of Group 1, Group 3, and SARS-CoV (Table 4 and FIG. 4B). InterProScan analysis predicts it as a type I membrane glycoprotein. Important features of the S protein of CoV-HKU1 are depicted in FIG. 5. PrositeScan of the S protein of CoV-HKU1 reveals 28 potential N-linked glycosylation (12 NXS and 16 NXT) sites. SignalP analysis reveals a signal peptide probability of 0.909, with a cleavage site between residues 13 and 14. By multiple alignments with the S proteins of other Group 2 coronaviruses, a potential cleavage site located after RRKRR (SEQ ID NO:19), between residues 760 and 761, where S will be cleaved into S1 and S2, is identified. Immediately upstream to RRKRR (SEQ ID NO:19), there is a series of five serine residues that are not present in any other known coronaviruses (FIG. 5). Most of the S protein (residues 15 to 1300) is exposed on the outside of the virus, with a transmembrane domain at the C terminus (TMHMM analysis of the ORF shows one transmembrane domain at positions 1301 to 1356), followed by a cytoplasmic tail rich in cysteine residues. Two heptad repeats (HR), located at residues 982 to 1083 (HR1) and 1250 to 1297 (HR2), identified by multiple alignments with other coronaviruses, are present. In MHV, it has been confirmed that the receptor for its S protein binding is CEACAM1, a member of the carcinoembryonic antigen (CEA) family of glycoproteins in the immunoglobulin superfamily. Furthermore, it has been shown, by site-directed mutagenesis, that three conserved regions (sites I, II, and III) and some amino acid residues (Thr$^{62}$, Thr$^{212}$, Tyr$^{214}$, and Tyr$^{216}$ in MHV) in the N-terminal of the S protein are particularly important for its receptor-binding activity. By multiple alignments with the N-terminal 330 amino acids of the S protein of MHV and other group 2 coronaviruses, it is observed that these conserved regions and amino acids are present in CoV-HKU1 (FIG. 5). This infers that the receptor for CoV-HKU1 could be a member of the CEA family on the surface of the cells in the respiratory tract. On the other hand, for HCoV-OC43, it has been shown in vitro that the receptor for the S protein is a sialic acid. However, the amino acid residues on the S protein of HCoV-OC43 that are important for receptor binding are not well defined.

ORF4 (bases 27051-27380) encodes a predicted protein with 109 amino acids. This ORF overlaps with the ORF that encodes the E protein. PFAM analysis of the ORF shows that the predicted protein is a member of the coronavirus non-structural protein NS2 family (PFAM accession no.: PF04753). TMpred and TMHMM analysis do not reveal any transmembrane helix. This predicted protein of CoV-HKU1 has 44-51% amino acid identities with the corresponding proteins of other Group 2 coronaviruses.

ORF5 (bases 27373-27621) encodes the predicted E protein with 82 amino acids. The E protein of CoV-HKU1 has 54-60% amino acid identities with the E proteins of other Group 2 coronaviruses, but has fewer than 35% amino acid identities with the E proteins of Group 1, Group 3, and SARS-CoV (Table 4 and FIG. 4B). PFAM and InterProScan analyses of the ORF show that the predicted E protein is a member of the non-structural protein NS3/Small envelope protein E (NS3_envE) family (PFAM accession no.: PF02723). SignalP analysis predicts the presence of a transmembrane anchor (probability 0.995). TMpred analysis of the ORF shows two transmembrane domains at positions 16 to 34 and 39 to 59, and TMHMM analysis of the ORF shows two transmembrane domains at positions 10 to 32 and 39 to 58, consistent with the anticipated association of the E protein with the viral envelope. Both programs predict that both the N and C termini are located on the surface of the virus.

ORF6 (bases 27633-28304) encodes the predicted M protein with 223 amino acids. The M protein of CoV-HKU1 has 76-78% amino acid identities with the M proteins of other Group 2 coronavirus, but has fewer than 40% amino acid identities with the M proteins of Group 1, Group 3, and SARS-CoV (Table 4 and FIG. 4B). PFAM analysis of the ORF shows that the predicted M protein is a member of the coronavirus matrix glycoprotein (Corona_M) family (PFAM accession no.: PF01635). SignalP analysis predicts the presence of a transmembrane anchor (probability 0.926). TMpred analysis of the ORF shows three transmembrane domains at positions 21 to 42, 53 to 74, and 77 to 98. TMHMM analysis of the ORF shows three transmembrane domains at positions 20 to 39, 46 to 68, and 78 to 100. The N terminal 19-20 amino acids are located on the outside and the C terminal 123-125-amino acid hydrophilic domain on the inside of the virus.

ORF7 (bases 28320-29645) encodes the predicted N protein (PFAM accession no.: PF00937) with 441 amino acids. The N protein of CoV-HKU1 has 57-62% amino acid identities with the N proteins of other Group 2 coronaviruses, but has fewer than 40% amino acid identities with the N proteins of Group 1, Group 3, and SARS-CoV (Table 4 and FIG. 4B).

ORF8 (bases 28342-28959) encodes a hypothetical protein (N2) of 205 amino acids within the ORF that encodes the predicted N protein. PFAM analysis of the ORF shows that the predicted protein is a member of the coronavirus nucleocapsid I protein (Corona_I) family (PFAM accession no.: PF03187). This hypothetical N2 protein of CoV-HKU1 has 32-39% amino acid identities with the N2 proteins of other Group 2 coronaviruses.

We report the characterization and complete genome sequence of a novel coronavirus detected in the nasopharyngeal aspirates of patients with pneumonia. The clinical significance of the virus in the first patient was evident by the high viral loads in the patient's nasopharyngeal aspirates during the first week of his illness, which coincided with the acute symptoms developed in the patient. The viral load decreased during the second week of the illness and was undetectable in the third week of the illness. In addition, the fall in viral load was accompanied by the recovery from the illness and development of specific antibody response to the recombinant N protein of the virus. Similar to other recently discovered viruses, such as hepatitis C virus, GB virus C, transfusion transmitted virus, and SEN virus, the present virus could not be recovered from cell cultures using the standard cell lines. This could be related to the inherently low recovery rate of coronaviruses. Human coronaviruses are particularly difficult to culture in vitro. Many decades after the recognition of HCoV-229E and HCoV-OC43, there are still only a handful of primary virus isolates available and organ culture is required for primary isolation of HCoV-OC43. In our experience, SARS-CoV can only be recovered from less than 20% of patients with serologically and RT-PCR documented SARS-CoV pneumonia. Therefore, it is not surprising that the new coronavirus CoV-HKU1 has been so far proven difficult to culture in vitro. After the discovery of CoV-HKU1 in the first patient, we conducted a preliminary study on 400 nasopharyngeal aspirates that were collected last year during the SARS epidemic period. Among these 400 nasopharyngeal aspirates, CoV-HKU1 was detected in one specimen, with a viral load comparable to that of the first patient. These results have suggested that CoV-HKU1 is not only incidentally found in one patient, but a previously unrecognized coronavirus associated with pneumonia.

Genomic analysis has reveals that CoV-HKU1 is a Group 2 coronavirus. The genome organization of CoV-HKU1 concurs with those of other coronaviruses, with the characteristic gene order, i.e., 5'-replicase, S, E, M, N-3', short untranslated regions in both 5' and 3' ends, 5' conserved coronavirus core leader sequence, putative TRS upstream to multiple ORFs, and conserved pseudoknot in the 3' untranslated region. In contrast to coronaviruses of other groups, CoV-HKU1 contains certain features that are characteristics of Group 2 coronaviruses, including the presence of HE, ORF4, and N2. Phylogenetic analysis of the 3CL$^{pro}$, replicase, helicase, S, E, M, and N proteins showed that these genes of CoV-HKU1 were clustered with the corresponding genes in other Group 2 coronaviruses. However, the proteins of CoV-HKU1 formed distinct branches in the phylogenetic trees, indicating that CoV-HKU1 is a distinct member of the group, and is not very closely related to any other known members of Group 2 coronaviruses (FIGS. 4A and 4B).

In addition to phylogenetic analysis of the putative proteins, CoV-HKU1 exhibits certain features that are distinct from other Group 2 coronaviruses. Compared to other Group 2 coronaviruses, there is a deletion of about 800 bps between the replicase ORF 1b and the HE ORF 2 in CoV-HKU1. In other Group 2 coronaviruses, including MHV, SDAV, HCoV-OC43 and BCoV, an ORF of 798-837 bp (273-278 amino acids) is present between the replicase 1b ORF and the HE ORF 2. This ORF encodes a protein of the coronavirus non-structural protein NS2a family (PFAM accession no.: PF05213). The absence of this ORF in CoV-HKU1 indicates that this is probably a non-essential gene of coronavirus. In addition to the deletion, the N-terminal of the putative PLP in ORF 1a contains 14 tandem copies of a 30-bp repeat that codes for a highly acidic domain. Similar repeats, with different amino acid compositions, have been found in the genomes of human, rat and parasites, but have not been found in other coronaviruses. The function of these repeats is not well understood, although some authors have suggested that the repeats could be important antigens, and their biological role may be related to their special three-dimensional structures. The vitellaria antigenic protein of *Clonorchis sinensis* contains 23 tandem copies of a 30-bp repeat that codes for DGGAQPPKSG (SEQ ID NO:20). In the case of *Plasmodium falciparum*, it has been shown that the antigenicity of the circumsporozoite protein is due to its repeating epitope structure. It has also been suggested that the tandemly repeated peptide may induce strong humoral immune response in the infected host and thus may also be useful in serological diagnosis. Further experiments should be performed to delineate the antigenic properties, biological role, and possible clinical usefulness of the repeat in the PLP of CoV-HKU1.

The geographical, political, and economic location of Hong Kong makes it a unique place for the study of emerging infectious disease. Hong Kong, as the gateway of southern China, with thousands of people crossing the border on surface and by air every day, has a high potential of importing and exporting infectious diseases to and from China, countries in Southeast Asia and from the rest of the world. In 1997, the first 18 human cases of avian influenza A H5N1 virus infection were reported in Hong Kong. In early 2003, two cases of human infection caused by avian influenza A (H5N1) that was acquired in Fujian, were diagnosed in Hong Kong, which provided an early warning of the impending disease threat for humans and poultry in Southeast Asia that followed in 2004. For the SARS epidemic, although both epidemiological and genomic evidence revealed that the disease had first occurred in southern China in November 2002, it did not receive as much international attention until the disease was spread to Hong Kong and through Hong Kong to Singapore, Toronto, Vietnam, and the United States of America. As for emerging bacterial infections, 50% of the patients with gastroenteritis associated with the recovery of *Laribacter hongkongensis* had recent history of travel to southern China. In this report, one of the patients also had recent history of travel to Shenzhen of China prior to the development of the respiratory illness. We speculate that he might have contacted the virus in Shenzhen. More intensive surveillance of emerging infectious pathogens in this locality is warranted.

7. MARKET POTENTIAL

The genome of CoV-HKU1 is completely sequenced. This allows the development of various diagnostic tests as described hereinabove. In addition, this virus contains genetic information which is extremely important and valuable for clinical and scientific research applications.

8. EQUIVALENTS

Those skilled in the art will recognize, or be able to ascertain many equivalents to the specific embodiments of the invention described herein using no more than routine experimentation. Such equivalents are intended to be encompassed by the following claims.

All publications, patents and patent applications mentioned in this specification are herein incorporated by reference into the specification to the same extent as if each individual publication, patent or patent application was specifically and individually indicated to be incorporated herein by reference.

Citation or discussion of a reference herein shall not be construed as an admission that such is prior art to the present invention.

---

SEQUENCE LISTING (2918 sequences)

SEQ ID NO: 1 - DNA, 393 bp, Corononavirus-HKU1
  CDS (2)..(391)
tcgtgctatgccaaatattttgcgtattgttagtagtttagttttggcccgcaaacatgaattttgttgttcacatggtgatagattttatcgccttgcgaatgaatgtgctcaagttttgagtgaaatagttatgtgtggcggttgctattatgttaagcctggtggtactagcagtggtgatgcaactactgcttttgctaattctgtttttaatatatgtcaggctgttactgctaatgtttgttctcttatggcctgtaatggccataagattgaagatttaagtatacgcaatttacaaaaacgcttatactctaatgtttatcgtacagattatgttgattatacatttgttaatgagtattatgaatttttatgtaagcattttag

SEQ ID NO: 2 - protein, 130 aa, Corononavirus-HKU1
RAMPNILRIVSSLVLARKHEFCCSHGDRFYRLANECAQVLSEIVMCGGCYYVKPGGTSSGDATTAFANSVFNICQAVTANVCSLMACNGHKIEDLSIRNLQKRLYSNVYRTDYVDYTFVNEYYEFLCKHF

SEQ ID NO: 3 - DNA, 29942 bp, Corononavirus-HKU1
gaataagagcgaattgcgtccgtaccgtctatcagcttacgatctcttgtcagatctcattaaatctaaactttttaaacaagattccctgttatccatgcttgtgagtgtggtttaatcataatcttgtattttactttccacacttttcatctctctgccagtgacgtgttggttgtcctcagcgtccctcccataggtcgcaatgattaaaaccagcaaatacggtctcggcttcaagtgggcgccagaatttcgttggctgcttccggatgcagcggaggagttggctagtcctatgaagtcagatgagggtgggttatgcccctctactggtcaagcgatggaaagtgttggattcgtttatgataatcatgtgaagatagattgtcgctgcattcttggacaagaatggcatgtgcagtcaaatcttatccgtgatatttttgttcatgaagatctacatgttgtagaagttctaactaaaacagccgtaaagtccggtacggcaattttaattaaatcacctttgcatagcttgggtggttttcctaaagggtatgttatgggcttgttccgttcatacaagactaaacgttatgttgtacatcatctttctatgactacatctactactaattttggtgaagattttttgggttggattgtaccttttggttttatgccatcttatgttcacaaatggtttcaattctgtaggttgtatattgaagagagtgatttaataatttcaaattttaaatttgatgattatgattttagtgtagaagatgcttatgctgaggttcatgctgagcctaaaggtaaatattcacaaaaagcttatgctttacttagacaatatcgtggtattaaacccgtactttttgtagaccagtatggttgtgactattctggtaaattagcagattgtcttcaagcttatggtcattattctttgcaagatatgagacaaaagcagtctgtatggcttgccaattgtgactttgatattgtagtggcttggcatgtagttcgtgattcacgatttgttatgcgcctgcagactatagctactatttgtggtattaaatatgttgcacaacctacagaagatgtagtagatggagatgtagttatacgtgaacctgtacatttattatctgctgatgcaatagttttaaagcttcctagtttgatgaaagttatgactcatatggatgatttttctattaaatctatatataatgttgatttgtgtgattgtggttttgttatgcagtatggttatgtagattgttttaatgataattgtgatttttatggttgggtttcaggtaatatgatggatggtttttcttgtccattgtgttgtacagtttatgactctagcgaagttaaagcccaatcatctggtgttattcctgaaaatcctgtgttatttactaatagtactgatactgttaaccatgattcttttaatttgtatggttattctgtcacaccatttggttcttgtatatattggtcgccgcgtcctggattgtggattcctataattaaatcttcagtcaagtcttatgatgatttggtttattcaggtgtagtaggttgtaaatctattgttaaagaaactgctcttattactcatgcactttacttagattatgttcaatgtaagtgtggtaatcttgaacaaaatcatattcttggcgttaataattcttggtgtaggcaactgttgcttaatagaggtgattataatatgcttctaaaaaatattgacttgtttgttaagcgtcgtgctgattttgcttgcaagtttgcagtttgtggagatggttttgtaccttttttactagatggtttaattccccgtagttattatctaattcagagtggtattttctttacatctttgatgtctcaattttcacaagaagtttctgatatgtgtttaaaaatgtgtattttgtttatggacagagtttcagttgctacattttatatagagcattatgttaataggttggttactcaatttaagttattgggtactacacttgttaataaaatggttaattggtttaataccatgttagatgctagtgcacctgctacaggctggcttctttaccaattattgaatggtctttttgtagtatctcaagccaactttaattttgttgctttaatacctgattatgctaaaattttagttaataaattttacactttttttaagttattattagagtgtgttacagttgatgttttaaaagatatgcctgttcttaaaactattaatggtttagtttgtattgtaggcaataagttttataacgttagtacagggttaattcctggttttgttttaccatgtaatgcacaggaacaacaaatttatttttttgaaggcgttgcagaatctgttatagtagaagatgatgttattgagaatgtcaaatcttctttatcatcttatgagtattgtcaaccacctaaatctgtagaaaaaatttgtattatagataatatgtacatgggtaagtgtggtgataaatttttccctattgtcatgaatgataaaaatatttgtcttttagatcaggcttggcgttttccatgtgcaggtagaaaagttaattttaacgagaaacctgttgttatggagattccgtctttgatgacagttaaggttatgtttgatttagattctacttttgatgatattttaggtaaagtttgttcagaatttgaagtagaaaagggtgttactgtagatgattttgttgctgttgtttgtgatgctatagagaatgctttaaactcttgtaaagagcatccagtggttggttatcaagttcgtgcatttttaaataaacttaatgagaatgttgtttatttatttgatgaggctggtgatgaagcaatggcctctcgtatgtattgtacttttgctattgaggatgttgaagacgttatcagtagtgaagctgtcgaagatactattgatggtgtcgttgaagacactattaatgacgatgaagatgttgttactggtgacaatgacgatgaagatgttgttactggtgacaatgacgatgaagatgttgttactggtgacaatgacgatgaagatgttgttactggtgacaatgacgatgaagatgttgttactggtgacaatgacgatgaagatgttgttactggtgacaatgacgatgaagatgttgttactggtgacaatgacgatgaagatgttgttactggtgacaatgacgatgaagatgttgttactggtgacaatgacgatgaagatgttgttactggtgacaatgacgatgaagatgttgttactggtgacaatgacgatgaagatgttgttactggtgacaatgacgatgaagatgttgttactggtgacaatgacgatgaagatgttgttactggtgacaataacgatgaagagattgttactggtgacaatgatgaccaaattgttgttactggtgatgatgtagatgatattgaaagtatttatgactttgatacttataaagctcttttagtttttaatgatgtctataatgatgctttgtttgttagttatggttctagtgttgaaacagaaacatattttaaagttaatggtttatggtcacctactattacacatactaattgttggttgcgttctgtgttacttgtaatgcagaaattaccttttaagtttaaggatttagctattgaaaatatgtggttatcttataaggtgggttataatcaaagttttgttgattatttactgaccactattcctaaagctattgttttgcctcaaggtggttttgtagctgattttgcttattggtttttaaaccagtttgatattaatgcgtatgctaattggtgttgtttaaaatgtggtttttcttttgatttaaatggtttggatgctttgtttttttatggagatattgtgtctcatgtttgtaagtgtggacataatatgactctaatagcagcggacttaccttgtacattacatttttcattatttgatgacaatttttgtgctttttgcacccctaaaaaaatttttattgctgcatgtgctgtggatgtaaacgtttgtcattctgtagctgttataggtgatgaacaaatagatggtaagtttgttactaaatttagtggtgataaatttgattttatagtaggttatggaatgtcatttagtatgtcttcttttgagttacctcaattgtatggtttgtgtataacacctaatgtatgttttgttaaaggtgatattataaatgttgctagacttgttaaagctgatgttattgttaatcctgctaatgggcatatgctccatggtggtggagttgcaaaagctatagctgtagctgcaggtaaaaaattttctaaagaaactgctgctatggttaaatctaaaggtgtttgccaagtaggagattgttatgtttctaccggtggtaaattatgtaaaacaattcttaatattgtaggccctgatgctagacaagatggaagacaatcttatgttttgttagcacgtgcttataagcatcttaataattatgattgttgtttgtctactctcatatcggctggtatatttagtgttcctgctgatgtgtcattaacttaccttctaggtgttgttgataaacaagttatccttgttagtaataataaagaagattttgatattattcaaaaatgtcaaattacttcagttgttggtactaaagcattggctgttagattaactgctaatgtaggccgtgttattaaatttgagacagatgcatacaaactttttttgagtggtgatgattgttttgtttcaaattcttctgttatacaagaagttttattgcttcgtcatgatatacaattgaataatgacgttcgtgattatttgttgtctaagatgactagtcttcctaaagattggcgtcttatcaataaatttgatgttattaacggtgttaaaactgttaagtattttgagtgtcctaattctatttatatatgtagtcagggtaaagactttggttatgtatgtgatggttctttttataaagcaactgttaatcaagtttgtgttttattagctaagaagatagatgttttgcttactgtagatggtgttaattttaaatctatttctcttactgtaggtgaagtttttggtaaaatacttggtaatgttttctgtgatggcattgatgttactaagttaaagtgtagtgatttttatgccgataaaattttatatcagtatgaaaatttgtctttagctgatatttctgctgtacaaagttcatttgggtttgatcagcaacaattgcttgcttattataattttttaacagtatgtaaatggtctgtagttgttaacggtccatttttttcttttgaacagtctcataataattgttatgtgaatgtagcttgtcttatgttgcagcatattaatcttaaatttaataaatggcagtggcaggaagcatggtatgaatttcgtgctggcagaccacataggttagttgctcttgttttagctaaaggtcattttaaatttgatgaaccatcagatgctactgattttattcgtgttgttttgaaacaagctgatttatcaggtgcaatttgtgaattagaacttatttgtgattgtggtattaaacaagaaagtcgtgttggtgttgatgctgttatgcattttggtacattagcaaagactgatctttttaatggttataagattggctgtaattgtgcaggtagaattgtccattgtactaaattgaatgtaccatttttgatttgttctaatactcctctgagtaaggatttacctgatgatgttgttgcagctaacatgtttatgggtgtaggtgtaggccattatacacatttgaaatgtggttcaccttaccaacattatgatgcttgtagtgttaaaaaatatacaggtgttagtggttgtttaactgactgcttgtatcttaaaaatttaacccagacttttacatctatgttgactaattattttttggatgatgttgaaatggttgcttataaccctgatctttcacaatattattgtgataatggtaagtattatacaaaacctattataaaggctcagtttaaaccatttgctaaagttgacggtgtttatactaactttaagttagttggacatgatatttgtgctcaattgaatgataagttaggttttaatgtagatttgccgtttgttgagtacaaagtaacagtctggcctgtagctactggtgatgttgttttggcatctgatgatttatatgtgaaacgttattttaaaggatgtgaaacttttggtaagcctgttatttggttttgtcatgatgaagcatcattgaattctcttacttattttaataaacctagttttaaatctgaaaatagatatagtgttttgtctgttgattctgtatctgaggagtcacaaggtaatgtggttacttctgttatggaatcgcagattagtactaaagaggttaagttaaagggtgttagaaagactgttaaaatagaagatgctattattgttaatgatgaaaatagttctattaaggttgttaaaagtttatctttagttgatgtttgggatatgtatttgacaggttgtgattatgttgtttgggttgctaatgaattgtcacgcctagttaaatcaccaacagttagggaatatatacgatatggtattaaacctattactatacctatagatttgttatgtttaagagatgataatcaaactcttttagttcctaaaatttttaaagcaagagctatagaattttatggttttttgaagtggttgtttatttatgtttttagtttattacattttacaaatgataaaaccattttttatactacagaaatagcttctaagtttacttttaatttgttttgtttggctcttaaaaatgcttttcagacatttagatggagtatatttataaaaggttttcttgttgtagccactgtgtttttgttttggtttaattttttgtatataaatgttatttttagtgacttttatcttcctaatattagtgtttttcctatttttgtgggaagaattgttatgtggataaaggctacttttggtttggttacaatttgtgatttttattctaagttaggtgtaggttttacaagtcatttttgtaatggtagttttatatgtgaattgtgtcattctggttttgatatgttggatacatatgcagctatagattttgttcagtatgaagtagatagacgtgttttatttgattatgttagtttagtcaaattaattgttgaactcgttattggttattcattatacacagtatggttttatccattattttgtcttattggtttacaattatttactacatggttgcctgatttgtttatgttagaaactatgcattggttgattagatttattgtatttgtagctaatatgttacctgcttttgtcttgttgcggttttatatagttgttactgctatgtataaagtagttggttttattaggcatattgtctatggttgtaataaagctggttgtttattttgttataaacgaaattgtagtgttcgtgttaagtgtagtactattgttggtggtgtaattcgttattatgatattactgctaatggtggtactggtttttgtgttaaacatcaatggaattgttttaattgccattcttttaaaccaggtaacacttttataactgtagaagctgctatagaactttctaaagagcttaaacgacctgtaaatccaactgatgcttcacattatgtagttactgatattaagcaagttggttgtatgatgcgtttgttctatgatagagatggacagcgtgtttacgatgatgttgatgctagtttatttgtagatattaataatctgttacattctaaagttaaagttgttcctaatttgtatgtagttgtagtagagagtgatgctgatagagctaattttctgaatgctgttgtgttttatgcacaatcattgtataggcctatattacttgtagacaaaaagttaattactacagcttgtaatggtatctctgtaacccagactatgtttgatgtttatgttgatacttttatgtctcattttgatgttgatagaaagagttttaataattttgttaacattgctcatgcttctcttagagagggtgtgcaattagaaaaggttttagatacttttgtgggatgtgtacgtaaatgttgttccattgattcagatgttgaaacaagatttattactaaatctatgatatctgcagtagctgctggtttggaatttactgatgaaaattataacaatttggtacctacatatttaaagagtgataatattgtagctgctgatttaggtgttcttatacagaatggtgctaagcatgtacagggtaatgttgctaaggcagctaatatttcttgtatatggtttattgatgcttttaatcaacttactgctgatttacagcataaattaaaaaaagcatgtgttaaaactggcttgaagttaaaattgacttttaataagcaagaggcaagtgtccctattcttacaacacccttttcacttaaaggaggtgttgtattgagtaatttgttatatatattattttttgttagtttaatctgttttatattattgtgggctttattgcctacatatagtgtttataagtctgatattcatttgcctgcttatgctagttttaaagttattgataatggtgttgttagagatatttcagttaatgatttatgttttgctaataaatttttccaatttgatcaatggtatgagtccacttttgggtctgtttactatcataattctatggattgccctattgtagtggcagttatggatgaagatatcggttctactatgtttaatgttcctactaaagttttgagacatggctttcatgttttacattttttaacttatgcatttgctagtgatagtgttcagtgctatacaccacatattcagatttcttataatgatttttatgctagtggttgtgttttatcatctttgtgtactatgtttaaaagaggtgatggtacaccacatccttattgttattcagatggtgttatgaagaatgcttctttgtatacatctttggttccacatacacgttatagccttgctaattctaatggttttataagatttcctgatgttattagtgaaggtattgtacgtattgtaagaacgcgctctatgacttattgtagagtgggtgcatgtgaatacgccgaagagggtatatgttttaattttaatagttcctgggttttgaataatgattattatagaagtatgcctggaactttttgtggtagagatctttttgatttgttttatcaattttttagtagtttaattcgtcctatagatttcttttctcttactgctagttctatttttggagctatattggctatagttgttgtcttggttttttattatttaataaaacttaagcgtgcttttggagattatactagtgttgtagttataaatgttgttgtttggtgtattaattttcttatgctttttgtttttcaagtttatcctatttgtgcatgtgtttatgcttgtttttatttttatgtaacattgtattttccttctgaaattagtgtaattatgcatttgcaatggattgttatgtatggtgctataatgcctttttggttttgtgtcacatatgtagctatggttattgcaaaccatgttttatggttattttcatattgtaggaaaattggtgttaatgtatgtagtgatagtacatttgaagaaacatctcttactacttttatgattactaaagattcttattgtagattaaagaattctgtttctgatgttgcctacaatagatatttgagtttgtataataagtatcgttactatagtggtaaaatggatactgctgcctatagagaagcggcgtgttctcagttagctaaagctatggaaacatttaatcacaataatggtaatgatgtcttataccaacctcctacagcatctgtttctacatcttttttgcaatcaggtattgtaaagatggtatctcctacgtcaaaaattgaaccttgtattgttagtgttacttatggtagtatgactttgaatggtttatggttagatgacaaagtttattgtcctcgtcatgttatatgttcatcctctaatatgaacgaacctgattattctgccttattgtgtagagttactctaggtgattttactataatgtctggtcggatgagtttaacagttgtgtcttaccagatgcagggctgtcaacttgttttgacagtctctttacaaaatccttacactccaaaatatacttttggtaatgttaaacctggtgaaacttttactgttttagctgcgtataatggccgaccacaaggggcatttcatgttactatgcgtagtagttatactattaaaggttcttttttgtgtgggtcatgtggatctgttggttatgtattaacaggtgatagtgttaagtttgtatatatgcatcaattagagctcagtactggttgtcacactggcactgattttactggtaatttttatggtccatatagagatgctcaagttgtacagttgccagttaaggactacgtccagactgttaatgttattgcttggctctatgcagctatacttaataattgtgcttggtttgtacaaaatgatgtttgttctactgaagattttaatgtttgggctatggcaaatggttttagccaagtaaaagcagatcttgtcttagatgctttggcttcaatgacaggtgtttctattgaaactttattggctgctattaagcgtctatatatgggatttcaaggtcgtcaaatactaggaagttgtacttttgaagatgaattggcaccttctgacgtttatcaacaattggctggtgttaaattgcaatctaaaacaaaaagatttattaaagaaacaatttattggattttgatatctacatttttgtttagttgtataatttctgcatttgttaaatggactatatttatgtatattaatacacatatgattggtgttacattatgtgtactttgttttgttagttttatgatgttactagttaaacataagcatttttatttgactatgtatataattcctgtactctgtaccttgttttatgtaaattatttagttgtttataaggaaggttttagaggttttacttatgtctggctctcatattttgttcctgctgtgaattttacttatgtttatgaagtattttatggttgtattttatgtgtttttgctatttttataactatgcatagtattaatcatgacattttttctttgatgtttttggttggtagaatagttactttaatttctatgtggtattttgggtcgaatttagaagaggatgttttgttatttattacagcctttttaggtacttatacatggaccactattttgtcattagctatagcaaaaattgttgctaattggttgtctgttaatatattttattttacagatgtaccttatattaaattgattctcttgagttacttatttatagggtatattttatcttgttattggggatttttctctcttttaaacagtgtttttagaatgcctatgggtgtttataattataaaatttctgttcaagaattgcgttatatgaatgctaatggcttacgtccacctcgtaatagttttgaggctattttgttaaatttaaaactgcttggaataggtggcgtgccagttattgaagtctcccaaattcaatcaaaattgactgatgtgaaatgtgctaatgttgttttgttaaattgtttacagcatttgcatgttgcttctaattctaagttgtggcagtattgtagtgttttacataatgaaatactatctacttcagatttgagtgtagcttttgataagcttgctcaattattgattgttttattcgccaatcctgctgcagttgatactaagtgtcttgcaagtatagatgaagttagcgatgattatgttcaagatagtaccgttttgcaggctttgcaaagtgagtttgtaaatatggctagttttgttgaatatgaagtcgcaaagaaaaatttggctgatgctaaaaatagtggttctgttaatcaacaacagataaaacagttagaaaaagcatgtaatatagctaagtctgtgtatgaacgtgataaagctgtagctcgcaaacttgaacgtatggcagacctagcacttactaacatgtataaagaggctcggattaatgataagaagagtaaagttgtttccgctttgcagacaatgctttttagcatggttcgtaaattggataatcaggctttaaattctattctggataatgctgttaaaggttgtgtacctttgagtgctattccagcattggctgctaatactttaactatagtaataccagataaacaagtttttgataaagttgttgataatgtttatgttacatatgctggtagtgtatggcatatacagactgttcaagatgctgatggtattaataaacagttaactgatattagtgttgattctaattggcctcttgttatcattgcgaacaggtataatgaagttgctaatgctgttatgcagaataatgagttgatgcctcataaattaaaaatacaagttgttaatagtggttctgatatgaattgtaatattcctactcaatgttattataataatggtagtagtggtagaatagtttatgctgttcttagtgatgttgatggtcttaagtatactaagataatgaaagatgatggaaattgtgttgttttagagcttgatcctccttgtaaattttctatacaagatgttaagggacttaaaattaagtatctttattttattaaaggatgtaacactttagctagagggtgggttgttggtactttatcttcaacaattagattgcaggctggtgttgctactgagtatgcagctaattcttctatactttcattatgtgcattttctgtagatcctaagaaaacttatttagattatatacaacaaggtggtgtacctataattaattgtgttaaaatgctctgtgatcatgctggtactggtatggccattactattaaacctgaggctactattaaccaagattcttatggtggtgcctcagtttgtatttattgccgtgcacgtgtagagcatccagatgtagatggtatatgtaaattacgtggtaaatttgtacaagtccctttgggtataaaagatcctattctttatgtgttaacacatgatgtttgtcaagtctgtggtttttggagagatggcagttgttcctgtgtaggttcaagtgtcgctgttcaatctaaagatttaaattttttaaacgggttcggggtactagtgtgaatgcccggctagtaccctgtgctagtggtttatctactgatgttcaattaagggcatttgacatttgtaataccaatagagctggtataggtttatattataaagtgaattgttgccgttttcagcgtatagatgacgacggtaataaattggataagttctttgttgtcaaaagaactaatttagaagtttataataaagagaaaacttattatgagttgactaaaagttgtggtgttgtggctgaacatgatttctttacatttgatattgatggtagtcgcgtgccacatatagttcgtaggaatctttcaaagtatactatgttagatctttgctatgcattgcgtcattttgatcgtaatgattgttcaatattgtgtgaaattctttgtgagtatgctgattgtaaagaatcctacttttctaagaaagattggtatgattttgttgaaaatcctgatattattaatatatataaaaaattaggccctatttttaatagagctttacttaatactgtcatttttgcagacaccttagttgaagtaggtttagttggtgttttaactttagataaccaagatttgtatggtcaatggtatgattttggtgattttatacaaacagccccagggtttggtgtggcagttgcagattcttactattcttatatgatgcctatgttgactatgtgtcatgtattagattgtgaattatttgttaatgatagttatagacaattcgatcttgtacagtatgattttactgattacaagttagagttgtttaataagtattttaagtattggggtatgaagtatcatcctaatactgtggattgtgataatgataggtgtattattcattgtgctaattttaatatactatttagtatggttttacctaatacttgttttggtccccttgttagacaaatttttgtagatggtgtaccgtttgttgtttctattggttaccattacaaagagttaggtgtagttatgaacttagatgttgacacacaccgttatcgtttgtctcttaaagatttacttctttatgcagcagatcctgctatgcacgttgcatctgctagtgctctgcttgatttacgaacttgttgttttagtgtagctgccattacaagtggtataaaatttcaaactgtaaaaccaggtaactttaaccaagacttttacgagtttgttaaaagtaaaggcttgtttaaagagggtagtacagttgatttgaaacattttttctttactcaagatggtaatgctgcaattactgattataattattataagtataatttacctactatggttgatattaagcagttattgtttgtattagaagttgtttataaatattttgaaatttatgatggtggttgtataccagcatcacaagttattgttaataattatgataaaagtgctggttatccatttaataaatttggtaaagccagactttattatgaggcattatcatttgaggaacagaatgaaatttatgcatatactaaacgtaatgttctgcccaccttaactcaaatgaatttaaaatatgctatcagtgctaagaatagagctcgcactgtagcaggtgtttctattcttagtactatgacaggccgaatgttccatcaaaaatgtttgaagagtatagcagctacccgaggtgttcctgttgttataggaaccactaaattttatggtggttgggacgatatgttacgtcatcttataaaggatgttgacaaccctgttcttatgggttgggattatcctaaatgtgatcgtgctatgccaaatattttgcgtattgttagtagtttagttttggcccgcaaacatgaattttgttgttcacatggtgatagattttatcgccttgcgaatgaatgtgctcaagttttgagtgaaatagttatgtgtggcggttgctattatgttaagcctggtggtactagcagtggtgatgcaactactgcttttgctaattctgtttttaatatatgtcaggctgttactgctaatgtttgttctcttatggcctgtaatggccataagattgaagatttaagtatacgcaatttacaaaaacgcttatactctaatgtttatcgtacagattatgttgattatacatttgttaatgagtattatgaatttttatgtaagcattttagtatgatgattttgagtgatgatggtgttgtctgttataactctgattatgctagtaagggttatatagctaatataagtgtttttcaacaagttttgtactatcagaataatgtctttatgtctgaatctaaatgttgggttgaaaatgatattactaatggtcctcatgaattttgttcccaacatactatgttagttaagatagatggtgattatgtttatttaccatatccagatccttctagaattttaggagctggttgttttgttgatgatttattgaagactgacagtgttcttttgatagagcgctttgtaagtctagctatagatgcttaccctttagtacatcatgaaaatgaagaataccaaaaagtctttcgtgtatatttagaatatataaaaaaactgtataatgatcttggtactcagatcttagatagttatagtgttattttaagtacttgtgatggtttaaagtttactgaagaatcattttacaagaatatgtatttaaaaagtgccgtgatgcagagtgtaggtgcatgcgttgtttgttcatcacaaacttctttgcgttgtggcagttgtatacgtaagcctttgttatgttgtaaatgttgttatgaccatgttatggcaactaatcataaatatgttttgagtgtctcaccttacgtttgtaatgcacctaactgtgatgtgagtgatgtcaccaaattatatttgggcggtatgtcttactattgtgaaaaccataaaccccattattcatttaagttagttatgaatggtatggtctttggtttgtataaacaatcttgcacgggttcaccttatatagatgattttaataagatagctagttgtaaatggacagaagttgatgattatgttctggcaaatgagtgtattgaacgtttaaagttatttgctgcagaaactcaaaaggcaactgaagaggcttttaaacaaagctatgcttctgctaccattcaagagattgttagtgatagagaagttattttgtgttgggagacaggtaaagttaaaccaccacttaataaaaattatgttttcacaggctaccattttactagtactggtaagacagttttaggtgagtatgtttttgataaaagtgaattaactaacggtgtgtattaccgcgctacaactacttataaactttctataggtgatgtttttgttttaacatcacattctgtagctagtttaagtgcacctacacttgtcccacaagagaactatgctagtataagattttctagtgtttatagtgttccattggtgtttcaaaataatgttgctaattatcagcacattggaatgaaacgttattgcactgttcaaggtccccctggtacgggaaagtctcatcttgctataggtctagctgtttattactacacagcacgtgtagtttatactgctgctagtcatgctgctgtagatgcattgtgtgaaaaagcttataagtttttaaatattaacgattgtacacgtattattcctgctaaagttcgtgtagattgttatgataagtttaaaattaatgataccacttgtaagtatgtttttaccacaataaatgcattaccagagttggttacagatattgttgttgttgatgaagttagtatgcttactaattatgaattgtctgttataaatgctcgtattaaagctaaacattatgtatatattggagatcctgctcaattacctgcaccacgtgtgctgttgagcaagggttctttagaacctaggcacttcaattctattactaaaataatgtgttgtttaggtcctgatatctttttgggaaattgttataggtgtcctaaagaaattgtagaaactgtttcagcattggtttatgataataaactcaaggctaaaaatgataatagttcattatgttttaaagtatattttaagggacagacaacacatgagagttcaagtgctgtaaatattcaacagatatatctaattagtaaatttttaaaagctaatccagtttggaatagtgctgtttttattagtccttataatagtcagaattatgttgctaagcgtgttttaggtgttcaaacacaaactgtagattctgctcaaggttcggaatatgattatgttatatattcacaaacagcagaaacagcccattctgttaatgttaatcgatttaatgttgccataactagagccaagaagggcattttttgtgttatgagtaatatgcaattatttgaatctcttaattttattactctacctttagataaaattcaaaatcaaactttacctcgtttgcattgcacaactaatctttttaaagattgtagtaaaagttgcttaggttatcatccagcgcatgccccctcatttttagcagttgatgataaatataaggttaatgaaaatttggctgtaaatttaaatatttgtgaacctgttttaacatattctcgtttaatatctcttatgggttttaaattagatttgactcttgatggttattctaaattgtttattactaaagatgaagccattaaacgtgttagaggttgggttggttttgatgttgagggcgctcatgctactcgcgaaaacattggaacaaactttccactgcaaataggtttttcaactggtgtggattttgtagttgaagctactggcttatttgctgagagagattgttatacttttaaaaaaactgtagctaaagctcctcctggtgaaaaatttaaacatttaataccccttatgtcaaaaggtcaaaagtgggatattgttagaattagaattgttcaaatgttatctgattatcttttagacctttctgatagtgtagtatttattacttggtctgccagttttgaacttacttgtttaaggtattttgctaaattaggcagagagcttaattgtaatgtgtgttctaatcgtgctacatgctacaattctagaactggttattatggttgttggcgccatagttatacttgtgattatgtgtataatccacttattgtagatatacaacagtggggttatacaggttctttaactagtaatcacgatataatttgtaatgtacataaaggtgcacatgttgcgtcagctgatgcaattatgactcgttgtttagcaatctatgattgtttttgtaaatctgttaattggaatttagagtatccaataatttctaatgaggtcagtataaatacatcttgtaggttattgcagcgtgtcatgcttaaagctgccatgctatgtaatagatacaacttatgttatgacataggcaatcctaaaggtttagcttgtgtcaaagattatgaatttaaattttatgatgcttttcctgtagccaagtctgttaaacagttattttatgtctatgatgtgcataaagataattttaaagatggtttatgtatgttttggaattgtaatgttgataaatatccatctaattcaattgtttgtagatttgacactcgagtgttaaataaattaaaccttcctggatgtaatggtggtagtttgtatgttaataaacatgcattccatactaatccttttactagaactgtttttgaaaatcttaagcctatgccttttttctattattcagatacgccttgtgtgtacgtagatggtttagaatctaaacaagttgattacgttcctttaagaagcgccacttgtatcacacggtgtaatctaggtggagctgtttgttcaaagcatgctgaagaatattgtaactaccttgagtcttataatatagttactacagcaggctttactttttgggtttataagaattttgatttttataatttatggaacacttttactacgttacagagtttagaaaacgtaatatataacttggttaatgttggtcattatgatggacgtacaggtgaattaccttgtgctattatgaatgacaaagttgttgttaagattaataatgtagatactgttatttttaaaaataatacatcatttcctactaatatagctgttgaattgtttacaaaacgtagtatccggcaccaccctgaacttaagattcttagaaatttgaacattgatatttgttggaagcatgtcctgtgggattatgttaaagatagtttgttttgtagttccacttatggtgtttgtaaatacacagatttgaagttcatcgaaaatttgaatatactttttgatggtcgtgacactggcgctttagaagcttttagaaaagcaagaaatggtgtttttattagtactgaaaaattaagtaggttatcaatgattaaaggtccgcaacgagctgatttaaatggtgtgattgtggataaagttggagaactcaaagttgagttttggttcgctatgagaaaagatggtgacgatgttatcttcagccgaacagacagcctatgctcaagccattactggagcccacaaggtaatctaggtggtaattgcgcgggtaatgtcattggtaatgatgctctaacacgttttactatctttactcagagtcgtgtattgtcaagttttgaacctcgctcagatttagaacgggattttattgatatggatgataatctgtttattgctaaatatggtttagaagactatgcatttgatcatatagtttatggtagttttaaccataaagttataggaggtttgcatttgcttataggcttatttcgtaggaaaaaaaaatctaatttgttaattcaagagtttttacagtatgattctagtattcattcatattttattactgatcaggagtgtggtagtagtaagagtgtttgtacagttattgatttattattagatgattttgtttctattgttaagtcattaaatttgagttgtgttagtaaagttgttaatattaatgttgattttaaggattttcaatttatgttgtggtgtaatgataataaaattatgactttttatcctaaaatgcaagccactaatgattggaaacctggctattctatgcctgttttgtataagtatttgaatgttccattagagagagtctctttatggaattatggtaaacctattaatttgcctacaggctgtatgatgaatgttgctaagtacactcaattatgtcagtatttgaatactacaacattagctgttcctgttaatatgcgtgttttacatttaggtgcagggtctgataaagaagtagctccaggttctgctgttttaagacagtggttaccatctggtagtattcttgtagataatgatttaaacccatttgttagcgatagtttagttacttattttggagattgtatgactttaccatttgattgtcattgggatttgataatatctgatatgtatgatcctcttactaaaaatattggtgattataatgtgagtaaggatgggttttttacttacatttgtcatttaattcgtgataaattatctttgggtggtagtgtagctataaaaattacagagttttcttggaatgctgatttatataaattaatgagttgttttgcattttggacagttttttgtactaatgtaaatgcttcttctagtgaagggtttttaataggtataaattacctgggtaaatcttcttttgaaatagatggcaatgttatgcatgctaactatttgttttggagaaatagtacaacatggaatggcggtgcttatagtttatttgatatgactaaattttctttgaaattggctggcactgctgttgttaatttaagaccagatcaattaaatgatttagtttattctcttattgaaagaggtaaattattagttcgcgatacgcgtaaagagatttttgttggtgatagtcttgtaaatacttgttagatctcattaaatctaaactatgttaattatttttttatttttttatttctgttatggttttaatgaacctcttaatgttgtgtctcatttaaaccatgactggtttttatttggtgatagtcgttctgattgtaaccatattaataatttaaaaattaaaaattttgattatttggatattcaccctagtttgtgcaacaatggtaagatttcatctagtgccggtgattctatttttaagagttttcatttcactcgattttataattacactggcgaaggtgatcaaattattttttatgagggtgttaattttaatccttatcatagatttaagtgttttcctaatggtagtaatgatgtatggcttcttaacaaggtaagattttatcgtgccttatattctaatatggccttttttcgttatcttacttttgttgatattccttataatgtttctctttctaagtttaattcttgtaaaagtgatattttatcacttaacaatcctatttttattaattattctaaggaagtttattttactttattaggttgttctctttatttagtaccgctttgcctttttaaatctaactttagtcagtactattataacatagatactggctctgtttatggtttttctaatgttgtttatcctgatttagactgtatttatatttctcttaaaccaggttcttataaagtttccaccactgcaccttttttatccttacctactaaagctctctgttttgataaatctaaacaatttgtacctgtacaggttgttgattctagatggaacaacgagcgtgcctcagatatttctttatctgttgcatgtcaattgccatattgttattttcgcaattcttctgctaattatgttggcaagtatgatattaaccacggtgatagtggttttatttctattttatctggtcttttatataatgtttcttgtatttcatattatggtgtatttttatatgataattttacatccatttggccctattattcttttggtaggtgtcctacatcttctattattaaacatccaatttgtgtttatgattttttgcctattattttacaaggtattttattatgtttagctttactttttgttgtttttctattatttttgttatataacgataaatctcattaaatctaaacatgttattaattatttttattttgcctacaacattagctgttataggtgattttaattgtactaattttgctattaatgatttaaacaccacagttcctcgcataagtgagtatgttgtggatgtttcttatggtttgggtacatattatatacttgatcgtgtttatttaaatactactatattatttactggttatttccctaaatctggtgccaattttagggatctatctttaaaaggtactacatatttgagtactctttggtatcagaaaccctttttatctgattttaataatggtattttttctagagttaagaatactaagttgtatgttaataaaactttgtatagtgagtttagtactatagttataggtagtgtttttattaacaactcttatactattgttgttcaacctcataatggtgttttggagattacagcttgtcaatacactatgtgtgagtatcctcatactatttgtaaatctaaaggtagttctcgtaatgaatcttggcattttgataaatctgaacctttgtgtctgttcaagaaaaattttacttataatgtttctacagattggttgtattttcatttttatcaagaacgtggcactttttatgcttattatgctgattctggcatgcctactacttttttatttagtttgtatcttggtactcttttatctcattattatgttttgcctttgacttgtaatgctatatcttctaatactgataatgagactttacaatattgggtcacacctttgtctaaacgccaatatcttcttaaatttgacaaccgtggtgttattactaatgctgttgattgttctagtagtttctttagcgagattcaatgtaaaactaaatctttattacctaatactggtgtttatgacttatctggttttactgttaagcctgttgcaactgtacatcgtcgtattcctgatttacctgattgtgacattgataaatggcttaacaattttaatgtaccctcacctcttaattgggaacgtaaaattttttctaattgcaactttaatttgagtactttgcttcgtttagttcatactgattctttttcttgtaataattttgatgaatctaagatatatggtagttgttttaagagtattgttttagataaatttgccatacccaactccagacgatctgatttgcagttgggcagttctggttttctgcaatcttctaattataaaattgacactacttctagttcttgtcaattgtattatagtttgcctgcaattaatgttactattaataattataatccttcttcttggaatagaaggtatggttttaataattttaatttgagctctcatagtgttgtttactcacgttattgtttttctgttaataatactttttgtccttgtgctaaaccttcttttgcttcaagttgcaagagtcataaaccaccttctgcttcctgtcctattggtactaattatcgttcttgtgagagtactactgtactcgaccacactgactggtgtaggtgttcttgtttacctgatcctataactgcttatgaccctaggtcttgttctcaaaaaaagtctctggttggtgttggtgaacattgtgcagggttcggtgttgatgaagaaaagtgtggtgtattggatggatcatataatgtttcttgtctttgtagtactgatgcctttctaggttggtcttatgacacttgcgtcagtaacaaccgttgtaatattttttctaattttattttaaatggtatcaatagtggtaccacttgttctaatgatttattgcagcctaatactgaagtttttactgatgtttgtgttgattacgacctttatggtattacaggacaaggtatttttaaagaagtttctgctgtttattataatagttggcaaaatcttttgtatgattctaatggcaacattattggttttaaagattttgttactaataaaacatataatattttcccttgttatgcaggaagagtttctgctgcttttcatcaaaatgcttcctctttggctttactttatcgtaatttaaaatgtagctatgttttgaataatatttctttaactactcagccatattttgatagttatcttggttgcgtttttaatgctgataatttaactgattattctgtttcttcttgtgctcttcgcatgggtagtggtttttgtgttgattataactcaccttcttcttcctcttcgcgtcgtaaacgtagaagtatttctgcttcttatcgttttgttacttttgaaccctttaatgtcagttttgttaatgacagtattgagtctgtgggtggtctttatgagatcaaaattcccactaactttactatagttggtcaagaggaatttattcaaactaattctcctaaagttactattgattgttctttatttgtctgttctaattatgcagcttgccatgacttattgtcagagtatggcactttttgtgataatattaatagtattttagatgaagttaatggtttacttgatactactcaattgcatgtagctgatactcttatgcaaggtgtcacacttagctccaatcttaatactaatttgcattttgatgttgataatattaattttaaatccctagttggatgtttaggtccacactgcggttcttcttctcgttctttttttgaagatttattgtttgacaaagttaaactttcagatgttggttttgttgaagcttataacaattgtactggtggtagtgaaattagagatcttctttgtgtacaatcctttaatggtattaaagttttgcctcctattttgtctgaatctcaaatttctggttacaccacagccgctactgttgctgctatgtttccaccatggtcagcagcagctggcataccattttctcttaatgtacaatatagaattaatggtttgggtgttactatggatgttcttaataaaaatcaaaagttgatagctactgcttttaataatgctcttctttctattcagaatggttttagtgctaccaactctgcacttgctaaaatacaaagtgttgttaattctaatgctcaagcacttaatagtttgttacagcaattatttaataaatttggtgcaattagttcttctttacaagaaattttatctcgtctcgatgctttagaggctcaggttcagattgataggcttattaatggtcgtttaactgctttaaatgcttatgtctctcaacagcttagtgatatttctcttgtaaaatttggtgctgctttagctatggagaaggttaatgagtgtgttaaaagtcaatctcctcgtattaatttttgtggtaatggtaatcatattttgtcattagttcaaaatgctccttatggtttgttgtttatgcattttagttataaacctatttcttttaaaactgttttagtaagtcctggtttgtgtatatcaggtgatgtaggtattgcacctaaacaagggtattttattaaacataatgatcattggatgttcactggtagttcttactattatcctgaaccaatttcagataaaaatgttgtttttatgaatacttgttctgttaattttactaaagcgcctcttgtttatttgaatcattctgtaccaaaattgtctgattttgaatctgagttatctcattggtttaaaaatcaaacatccattgcgcctaatttgactttaaatcttcatactattaatgctacttttttagatttgtattatgagatgaatcttattcaagagtctattaagtctttgaataatagttatatcaatcttaaagatataggtacatatgaaatgtatgtaaaatggccttggtatgtttggctactaatttctttttcatttataatattccttgtattgctcttttttatatgttgttgtactggttgtggttctgcatgttttagtaaatgtcataattgttgtgatgagtatggtggtcatcatgattttgttatcaaaacatctcatgatgattagaatctcttgtcagatctcattaaatctaaactttatttatggacgtttggagacctagctacacacattctcttgttattagagaatttggtgttacaaaccttgaagatttgtgtctaaagtataattactgtcaacctattgttggttactgtattgtacctttaaatgtttggtgtcgcaagtttggcaaatttgcttctcactttacattacgtagtcacgatatttcccatagtaataattttggtgttgtaactagttttactacttatggtaatactgtttctgaggctgtgtctagattagttgaatcagcttctgaatttattgtttggcgtgcagaggcacttaataagtatggttgatttatttttcaatgatactgcttggtacataggacagattttagttttagttttattttgtcttatttctttaatctttgttgttgcttttttagcaactattaagctttgtatgcaactttgtggtttttgtaatttctttattatttcaccttcggcttacgtttataaaagaggtatgcagttgtataagtcttatagtgaacaagttataccacccacttcagattatttaatctaaatctaaacattatgaataaatcttttcttcctcaatttacttctgatcaagctgttacattcttaaaagaatggaatttctctttgggtgtaatactactttttattactatcatattgcagttcggttatacgagccgtagtatgtttgtttatcttatcaagatgattattctttggcttatgtggccattgactatcaccttgactatatttaattgtttttatgctttgaataatgcttttcttgcattttctatagtgtttactattatttctattgttatatggattctttattttgttaatagtattcggctttttattagaactggcagttggtggagttttaatccagagaccaataatcttatgtgtattgatatgaaaggcaagatgtttgttaggccagttattgaggactatcacacattaactgctactgttattcgtggtcatctttatatacagggtgtcaaacttggcactggttatactctttcagatttgcccgtatatgttactgtagctaaggtgcaagtactttgtacctataaacgtgcctttttagataagttagatgttaatagtggttttgctgtttttgttaagtctaaagttggtaactatcgtttaccgtctagtaaacctagtggtatggatactgccttgttaagagcttaaatctaaactattaggatgtcttatactcccggtcattatgctggaagtagaagctcctctggaaatcgttcaggaatcctcaagaaaacttcttgggctgaccaatctgagcgaaattaccaaacctttaatagaggcagaaaaacccaacctaaattcactgtgtctactcaaccacaaggaaatactatcccacattattcctggttctccgggatcactcaatttcaaaaaggtagagactttaaattttcagatggtcaaggagttcccattgctttcggagtacccccttctgaagcaaaaggatattggtatagacacagccggcgttcttttaaaacagctgatggtcaacaaaagcagttgttaccgagatggtatttctactatctcggtaccggcccatatgccaatgcatcctatggtgaatccctcgaaggggtcttctgggttgctaatcaccaagctgacacttctactccctccgatgtttcgtcaagggatcctactactcaagaagctatccctactaggtttccgcctggtacgattttgcctcaaggctattatgttgaaggctcaggaaggtctgcttctaatagtcgaccaggttcacgttctcaatcacgtggacccaataatcgttcattaagtagaagtaattctaattttagacattcagattctatagtaaaacctgatatggctgatgagatcgctaatcttgttttagccaagcttggtaaagattctaaacctcagcaagtcactaagcaaaatgccaaggaaatcaggcataaaattttaacaaaacctcgccaaaagcgaactcctaataaacattgtaatgttcaacagtgttttggtaaaagaggaccttctcaaaattttggtaatgctgaaatgttaaagcttggtactaatgatcctcagtttcctattcttgcagaattagctcctacaccaggtgcttttttctttggttctaaattagacttggttaaaagagattccgaggctgactcacctgttaaagatgtttttgaacttcattattctggttctattaggtttgatagtactttaccaggctttgagacaattatgaaagttcttgaagagaatttaaatgcttacgttaattctaatcagaacactgattctgattcgttgagttctaaacctcagcgtaaaagaggtgttaaacaattaccagaacagtttgactctcttaatttaagtgctggtactcagcacatttcaaatgattttactcctgaggatcatagtttacttgctactcttgatgatccttatgtagaagactctgttgcttaatgagaatgaatcctaattcgacactaggtggtaacccctcgctattattcggaataggacactctctatcagaatgaattcttgctgtaataacagatagagtaggttgttacagactatatattaattagtagaaattttatatttagacatttgattgttagagtagttataaggtttagctgtagtataaacgcctccgggaagagctatcaattgtagtgtttaatatatatattagtatatgattgaaattaattatagccttttggaggaattacaaaaaaaaaaaaaaaa

SEQ ID NO: 4 - DNA, 23 bp, Artificial Sequence
  Primer
ggttgggactatcctaagtgtga

SEQ ID NO: 5 - DNA, 24 bp, Artificial Sequence
  Primer
ccatcatcagatagaatcatcata

SEQ ID NO: 6 - DNA, 38 bp, Artificial Sequence
  Primer
ttttccttttgcggccgcttaagcaacagagtcttcta

SEQ ID NO: 7 - DNA, 27 bp, Artificial Sequence
  Primer
cggaattcgatgtcttatactcccggt

SEQ ID NO: 8 - RNA, 22 nt, Corononavirus-HKU1
uuaaaucuaaacuuuuuaaaug

SEQ ID NO: 9 - RNA, 16 nt, Corononavirus-HKU1
uuaaaucuaaacuaug

SEQ ID NO: 10 - RNA, 15 nt, Corononavirus-HKU1
uuaaaucuaaacaug

SEQ ID NO: 11 - RNA, 22 nt, Corononavirus-HKU1
uuaaaucuaaacuuuauuuaug

SEQ ID NO: 12 - RNA, 18 nt, Corononavirus-HKU1
cuaaaucuaaacauuaug

SEQ ID NO: 13 - RNA, 22 nt, Corononavirus-HKU1
uuaaaucuaaacuauuaggaug

SEQ ID NO: 14 - RNA, 44 nt, Corononavirus-HKU1
uuaaaucuaaacuauuaggaugucuuauacucccggucauuaug

SEQ ID NO: 15 - protein, 140 aa, Corononavirus-HKU1
NDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNDDEDVVTGD

SEQ ID NO: 16 - protein, 10 aa, Corononavirus-HKU1
NNDEEIVTGD

SEQ ID NO: 17 - protein, 10 aa, Corononavirus-HKU1
NDDQIVVTGD

SEQ ID NO: 18 - protein, 4 aa, Corononavirus-HKU1
FGDS

SEQ ID NO: 19 - protein, 5 aa, Corononavirus-HKU1
RRKRR

SEQ ID NO: 20 - protein, 10 aa, Clonorchis sinensis
DGGAQPPKSG

SEQ ID NO: 21 - protein, 344 aa, Human coronavirus OC43
MFLILLISLPTAFAVIGDLKCTSDTSYINDKDTGPPPISTDTVDVTNGLGTYYVLDRVYLNTTLFLNGYYPTSGSTYRNMALKGSVLLSRLWFKPPFLSDFINGIFAKVKNTKVIKDRVMYSEFPAITIGSTFVNTSYSVVVQPRTINSTQDGYNKLQGLLEVSVCQYNMCEYPQTICHPNLGNHRKELWHLDTGVVSCLYKRNFTYDVNADYLYFHFYQEGGTFYAYFTDTGVVTKFLFNVYLGMALSHYYVMPLTCNSKVKNGFTLEYWVTPLTSRQYLLAFNQDGIIFNAVDCMSDFMSEIKCKTQSIAPPTGVYELNGYTVQPIADVYRRKLNLPNCNIE

SEQ ID NO: 22 - protein, 332 aa, Murine hepatitis virus
MLFVFILFLPSCLGYIGDFRCIQLVNSNGANVSAPSISTETVEVSQGLGTYYVLDRVYLNATLLLTGYYPVDGSKFRNLALTGTNSVSLSWFQPPYLSQFNDGIFAKVQNLKTSTPSGATAYFPTIVIGSLFGYTSYTVVIEPYNGVIMASVCQYTICLLPYTDCKPNTNGNKLIGFWHTDVKPPICVLKRNFTLNVNADAFYFHFYQHGGTFYAYYADKPSATTFLFSVYIGDILTQYYVLPFICNPTAGSTFAPRYWVTPLVKRQYLFNFNQKGVITSAVDCASSYTSEIKCKTQSMLPSTGVYELSGYTVQPVGVVYRRVANLPACNIE

SEQ ID NO: 23 - protein, 332 aa, Rat sialodacryoadenitis encephalitis virus
MLFVFLTLLPSCLGYIGDFRCINLVNTRISNARAPSVSTEVVDVSKGLGTYYVLDRVYLNATLLLTGYYPVDGSMYRNMALMGTNTLSLNWFEPPFLSEFNDGIYAKVKNLKASLPIGSASYFPTIIIGSNFVNTSYTVVLEPYNGIIMASICQYTICQLPHTDCKPNTGGNTLIGFWHTDLRPPVCILKRNFTFNVNAEWLYFHFYQQGGTFYAYYADVSSATTFLFSSYIGAVLTQYFVLPYMCSPTTSGVSSPQYWVTPLVKRQYLFNFNQKGIITSAVDCASSYTSEIKCKTQSMNPNTGVYDLSGYTVQPVGLVYRRVRNLPDCKIE

SEQ ID NO: 24 - protein, 334 aa, Bovine coronavirus
MFLILLISLPTAFAVIGDLKCTTVSINDVDTGVPSISTDTVDVTNGLGTYYVLDRVYLNTTLLLNGYYPTSGSTYRNMALKGTLLLSTLWFKPPFLSDFTNGIFAKVKNTKVIKDGVMYSEFPAITIGSTFVNTSYSVVVQPHTTILGNKLQGFLEISVCQYTMCEYPNTICNPNLGNQRVELWHWDTGVVSCLYKRNFTYDVNADYLYFHFYQEGGTFYAYFTDTGVVTKFLFNVYLGTVLSHYYVMPLTCNSALTLEYWVTPLTSKQYLLAFNQDGVIFNAVDCKSDFMSEIKCKTLSIAPSTGVYELNGYTVQPIADVYRRIPNLPDCNIE

SEQ ID NO: 25 - protein, 334 aa, Porcine hemagglutinating encephalomyelitis virus
MFFILLISLPSAFAVIGDLKCTTSLINDVDTGVPSISSEVVDVTNGLGTFYVLDRVYLNTTLLLNGYYPISGATFRNMALKGTRLLSTLWFKPPFLSPFNDGIFAKVKNSRFSKDGVIYSEFPAITIGSTFVNTSYSIVVEPHTSLINGNLQGLLQISVCQYTMCEYPHTICHPNLGNQRIELWHYDTDVVSCLYRRNFTYDVNADYLYFHFYQEGGTFYAYFTDTGFVTKFLFKLYLGTVLSHYYVMPLTCNSALSLEYWVTPLTTRQFLLAFDQDGVLYHAVDCASDFMSEIMCKTSSITPPTGVYELNGYTVQPVATVYRRIPDLPNCDIE

SEQ ID NO: 26 - protein, 334 aa, Equine coronavirus
MVLLLLFFLPGAFAVVGDVKCTTTGVNNFNSGAPVISTETVDVTNGLGTYYVLDRVYLNTTLLLNGYYPTSGANYRNLALKASGLLSTLWYKPPFLSEFNDGVFAKVKNTKVTKNGIVYSEFPTMAIGTTFVNTSYTVVVQPRTTVVNSKLQGLLEITICQYSMCEYPNTVCNSGIGSPRKELWHYEKAVASCLYRRNFTYDVNSDWLYFHFYQQGGTFYAYYTDSGFITTFLFNIYLGTSLSHYYVMPLSCSGKLDLQYWVTPLTNRQFLLVFNQDGIIYNAVDCASDYMSEIKCNTQNVKPSTGVYDLTGYTVQPIADVYRRIPNLPDCNME

SEQ ID NO: 27 - protein, 6 aa, Artificial Sequence
  -His tag
HHHHHH

SEQ ID NO: 28 - protein, 10 aa, Human coronavirus OC43
DYSKNRRSRG

SEQ ID NO: 29 - protein, 10 aa, Murine hepatitis virus
DYSKSRRADR

SEQ ID NO: 30 - protein, 10 aa, Rat sialodacryoadenitis encephalitis virus
NYSIAHRARR

SEQ ID NO: 31 - protein, 10 aa, Bovine coronavirus
DYSTKRRSRR

SEQ ID NO: 32 - protein, 10 aa, Porcine hemagglutinating encephalomyelitis virus
DYVTALRSRR

SEQ ID NO: 33 - protein, 10 aa, Equine coronavirus
DYSTARRQRR

SEQ ID NO: 34 - DNA, 29942 bp, Corononavirus-HKU1; identical to SEQ ID NO: 3
  CDS (1)..(29940)

SEQ ID NO: 35 - protein, 18 aa, Corononavirus-HKU1
ERIASVPSISLRSLVRSH

SEQ ID NO: 36 - protein, 44 aa, Corononavirus-HKU1
TRFPVIHACECGLIIILYFTFHTFHLSASDVLVVLSVPPIGRND

SEQ ID NO: 37 - protein, 26 aa, Corononavirus-HKU1
NQQIRSRLQVGARISLAASGCSGGVG

SEQ ID NO: 38 - protein, 5 aa, Corononavirus-HKU1
SYEVR

SEQ ID NO: 39 - protein, 18 aa, Corononavirus-HKU1
GWVMPLYWSSDGKCWIRL

SEQ ID NO: 40 - protein, 22 aa, Corononavirus-HKU1
SCEDRLSLHSWTRMACAVKSYP

SEQ ID NO: 41 - protein, 4 aa, Corononavirus-HKU1
YFCS

SEQ ID NO: 42 - protein, 9 aa, Corononavirus-HKU1
RSTCCRSSN

SEQ ID NO: 43 - protein, 11 aa, Corononavirus-HKU1
NSRKVRYGNFN

SEQ ID NO: 44 - protein, 4 aa, Corononavirus-HKU1
ITFA

SEQ ID NO: 45 - protein, 5 aa, Corononavirus-HKU1
LGWFS

SEQ ID NO: 46 - protein, 12 aa, Corononavirus-HKU1
RVCYGLVPFIQD

SEQ ID NO: 47 - protein, 14 aa, Corononavirus-HKU1
TLCCTSSFYDYIYY

SEQ ID NO: 48 - protein, 23 aa, Corononavirus-HKU1
RFFGLDCTFWFYAILCSQMVSIL

SEQ ID NO: 49 - protein, 6 aa, Corononavirus-HKU1
FNNFKF

SEQ ID NO: 50 - protein, 6 aa, Corononavirus-HKU1
CRRCLC

SEQ ID NO: 51 - protein, 9 aa, Corononavirus-HKU1
IFTKSLCFT

SEQ ID NO: 52 - protein, 5 aa, Corononavirus-HKU1
TISWY

SEQ ID NO: 53 - protein, 10 aa, Corononavirus-HKU1
TRTFCRPVWL

SEQ ID NO: 54 - protein, 27 aa, Corononavirus-HKU1
ISRLSSSLWSLFFARYETKAVCMACQL

SEQ ID NO: 55 - protein, 9 aa, Corononavirus-HKU1
YCSGLACSS

SEQ ID NO: 56 - protein, 16 aa, Corononavirus-HKU1
FTICYAPADYSYYLWY

SEQ ID NO: 57 - protein, 17 aa, Corononavirus-HKU1
ICCTTYRRCSRWRCSYT

SEQ ID NO: 58 - protein, 7 aa, Corononavirus-HKU1
TCTFIIC

SEQ ID NO: 59 - protein, 7 aa, Corononavirus-HKU1
CNSFKAS

SEQ ID NO: 60 - protein, 9 aa, Corononavirus-HKU1
FDESYDSYG

SEQ ID NO: 61 - protein, 13 aa, Corononavirus-HKU1
LWFCYAVWLCRLF

SEQ ID NO: 62 - protein, 7 aa, Corononavirus-HKU1
FLWLGFR

SEQ ID NO: 63 - protein, 14 aa, Corononavirus-HKU1
YDGWFFLSIVLYSL

SEQ ID NO: 64 - protein, 8 aa, Corononavirus-HKU1
SPIIWCYS

SEQ ID NO: 65 - protein, 6 aa, Corononavirus-HKU1
KSCVIY

SEQ ID NO: 66 - protein, 26 aa, Corononavirus-HKU1
FVWLFCHTIWFLYILVAASWIVDSYN

SEQ ID NO: 67 - protein, 6 aa, Corononavirus-HKU1
IFSQVL

SEQ ID NO: 68 - protein, 9 aa, Corononavirus-HKU1
FGLFRCSRL

SEQ ID NO: 69 - protein, 16 aa, Corononavirus-HKU1
RNCSYYSCTLLRLCSM

SEQ ID NO: 70 - protein, 7 aa, Corononavirus-HKU1
TKSYSWR

SEQ ID NO: 71 - protein, 4 aa, Corononavirus-HKU1
ATVA

SEQ ID NO: 72 - protein, 6 aa, Corononavirus-HKU1
YASKKY

SEQ ID NO: 73 - protein, 23 aa, Corononavirus-HKU1
FCLQVCSLWRWFCTFFTRWFNSP

SEQ ID NO: 74 - protein, 22 aa, Corononavirus-HKU1
LLSNSEWYFLYIFDVSIFTRSF

SEQ ID NO: 75 - protein, 24 aa, Corononavirus-HKU1
YVFKNVYFVYGQSFSCYILYRALC

SEQ ID NO: 76 - protein, 5 aa, Corononavirus-HKU1
VGYSI

SEQ ID NO: 77 - protein, 7 aa, Corononavirus-HKU1
VIGYYTC

SEQ ID NO: 78 - protein, 5 aa, Corononavirus-HKU1
YHVRC

SEQ ID NO: 79 - protein, 23 aa, Corononavirus-HKU1
CTCYRLASLPIIEWSFCSISSQL

SEQ ID NO: 80 - protein, 6 aa, Corononavirus-HKU1
FCCFNT

SEQ ID NO: 81 - protein, 5 aa, Corononavirus-HKU1
ILHFF

SEQ ID NO: 82 - protein, 8 aa, Corononavirus-HKU1
VIIRVCYS

SEQ ID NO: 83 - protein, 8 aa, Corononavirus-HKU1
CFKRYACS

SEQ ID NO: 84 - protein, 8 aa, Corononavirus-HKU1
WFSLYCRQ

SEQ ID NO: 85 - protein, 11 aa, Corononavirus-HKU1
YRVNSWFCFTM

SEQ ID NO: 86 - protein, 9 aa, Corononavirus-HKU1
CTGTTNLFF

SEQ ID NO: 87 - protein, 10 aa, Corononavirus-HKU1
RRCRICYSRR

SEQ ID NO: 88 - protein, 9 aa, Corononavirus-HKU1
ECQIFFIIL

SEQ ID NO: 89 - protein, 5 aa, Corononavirus-HKU1
VLSTT

SEQ ID NO: 90 - protein, 9 aa, Corononavirus-HKU1
ICRKNLYYR

SEQ ID NO: 91 - protein, 4 aa, Corononavirus-HKU1
YVHG

SEQ ID NO: 92 - protein, 7 aa, Corononavirus-HKU1
IFPYCHE

SEQ ID NO: 93 - protein, 15 aa, Corononavirus-HKU1
KYLSFRSGLAFSMCR

SEQ ID NO: 94 - protein, 14 aa, Corononavirus-HKU1
RETCCYGDSVFDDS

SEQ ID NO: 95 - protein, 5 aa, Corononavirus-HKU1
FRFYF

SEQ ID NO: 96 - protein, 5 aa, Corononavirus-HKU1
SLFRI

SEQ ID NO: 97 - protein, 8 aa, Corononavirus-HKU1
SRKGCYCR

SEQ ID NO: 98 - protein, 6 aa, Corononavirus-HKU1
FCCCCL

SEQ ID NO: 99 - protein, 9 aa, Corononavirus-HKU1
CYRECFKLL

SEQ ID NO: 100 - protein, 14 aa, Corononavirus-HKU1
RASSGWLSSSCIFK

SEQ ID NO: 101 - protein, 6 aa, Corononavirus-HKU1
ECCLFI

SEQ ID NO: 102 - protein, 12 aa, Corononavirus-HKU1
SNGLSYVLYFCY

SEQ ID NO: 103 - protein, 4 aa, Corononavirus-HKU1
RRYQ

SEQ ID NO: 104 - protein, 6 aa, Corononavirus-HKU1
SCRRYY

SEQ ID NO: 105 - protein, 5 aa, Corononavirus-HKU1
RCCYW

SEQ ID NO: 106 - protein, 5 aa, Corononavirus-HKU1
RCCYW

SEQ ID NO: 107 - protein, 5 aa, Corononavirus-HKU1
RCCYW

SEQ ID NO: 108 - protein, 5 aa, Corononavirus-HKU1
RCCYW

SEQ ID NO: 109 - protein, 5 aa, Corononavirus-HKU1
RCCYW

SEQ ID NO: 110 - protein, 5 aa, Corononavirus-HKU1
RCCYW

SEQ ID NO: 111 - protein, 5 aa, Corononavirus-HKU1
RCCYW

SEQ ID NO: 112 - protein, 5 aa, Corononavirus-HKU1
RCCYW

SEQ ID NO: 113 - protein, 5 aa, Corononavirus-HKU1
RCCYW

SEQ ID NO: 114 - protein, 5 aa, Corononavirus-HKU1
RCCYW

SEQ ID NO: 115 - protein, 5 aa, Corononavirus-HKU1
RCCYW

SEQ ID NO: 116 - protein, 5 aa, Corononavirus-HKU1
RCCYW

SEQ ID NO: 117 - protein, 5 aa, Corononavirus-HKU1
RCCYW

SEQ ID NO: 118 - protein, 5 aa, Corononavirus-HKU1
RCCYW

SEQ ID NO: 119 - protein, 5 aa, Corononavirus-HKU1
RDCYW

SEQ ID NO: 120 - protein, 6 aa, Corononavirus-HKU1
PNCCYW

SEQ ID NO: 121 - protein, 5 aa, Corononavirus-HKU1
SSFSF

SEQ ID NO: 122 - protein, 4 aa, Corononavirus-HKU1
CFVC

SEQ ID NO: 123 - protein, 5 aa, Corononavirus-HKU1
NRNIF

SEQ ID NO: 124 - protein, 10 aa, Corononavirus-HKU1
WFMVTYYYTY

SEQ ID NO: 125 - protein, 15 aa, Corononavirus-HKU1
LLVAFCVTCNAEITF

SEQ ID NO: 126 - protein, 4 aa, Corononavirus-HKU1
GFSY

SEQ ID NO: 127 - protein, 6 aa, Corononavirus-HKU1
KYVVIL

SEQ ID NO: 128 - protein, 4 aa, Corononavirus-HKU1
SKFC

SEQ ID NO: 129 - protein, 7 aa, Corononavirus-HKU1
LFTDHYS

SEQ ID NO: 130 - protein, 11 aa, Corononavirus-HKU1
SYCFASRWFCS

SEQ ID NO: 131 - protein, 9 aa, Corononavirus-HKU1
FCLLVFKPV

SEQ ID NO: 132 - protein, 10 aa, Corononavirus-HKU1
LVLFKMWFFF

SEQ ID NO: 133 - protein, 18 aa, Corononavirus-HKU1
FKWFGCFVFLWRYCVSCL

SEQ ID NO: 134 - protein, 17 aa, Corononavirus-HKU1
YDSNSSGLTLYITFFII

SEQ ID NO: 135 - protein, 8 aa, Corononavirus-HKU1
QFLCFLHP

SEQ ID NO: 136 - protein, 21 aa, Corononavirus-HKU1
KNFYCCMCCGCKRLSFCSCYR

SEQ ID NO: 137 - protein, 4 aa, Corononavirus-HKU1
TNRW

SEQ ID NO: 138 - protein, 9 aa, Corononavirus-HKU1
FYSRLWNVI

SEQ ID NO: 139 - protein, 4 aa, Corononavirus-HKU1
YVFF

SEQ ID NO: 140 - protein, 11 aa, Corononavirus-HKU1
VTSIVWFVYNT

SEQ ID NO: 141 - protein, 4 aa, Corononavirus-HKU1
CMFC

SEQ ID NO: 142 - protein, 5 aa, Corononavirus-HKU1
YYKCC

SEQ ID NO: 143 - protein, 18 aa, Corononavirus-HKU1
WAYAPWWWSCKSYSCSCR

SEQ ID NO: 144 - protein, 6 aa, Corononavirus-HKU1
RNCCYG

SEQ ID NO: 145 - protein, 14 aa, Corononavirus-HKU1
RCLPSRRLLCFYRW

SEQ ID NO: 146 - protein, 4 aa, Corononavirus-HKU1
YCRP

SEQ ID NO: 147 - protein, 14 aa, Corononavirus-HKU1
TRWKTILCFVSTCL

SEQ ID NO: 148 - protein, 12 aa, Corononavirus-HKU1
LLFVYSHIGWYI

SEQ ID NO: 149 - protein, 10 aa, Corononavirus-HKU1
CVINLPSRCC

SEQ ID NO: 150 - protein, 5 aa, Corononavirus-HKU1
TSYPC

SEQ ID NO: 151 - protein, 13 aa, Corononavirus-HKU1
YYSKMSNYFSCWY

SEQ ID NO: 152 - protein, 4 aa, Corononavirus-HKU1
SIGC

SEQ ID NO: 153 - protein, 5 aa, Corononavirus-HKU1
CRPCY

SEQ ID NO: 154 - protein, 10 aa, Corononavirus-HKU1
DRCIQTFFEW

SEQ ID NO: 155 - protein, 17 aa, Corononavirus-HKU1
LFCFKFFCYTRSFIASS

SEQ ID NO: 156 - protein, 4 aa, Corononavirus-HKU1
YTIE

SEQ ID NO: 157 - protein, 4 aa, Corononavirus-HKU1
LFVV

SEQ ID NO: 158 - protein, 6 aa, Corononavirus-HKU1
RLASYQ

SEQ ID NO: 159 - protein, 5 aa, Corononavirus-HKU1
FYLYM

SEQ ID NO: 160 - protein, 6 aa, Corononavirus-HKU1
RLWLCM

SEQ ID NO: 161 - protein, 4 aa, Corononavirus-HKU1
WFFL

SEQ ID NO: 162 - protein, 7 aa, Corononavirus-HKU1
SSLCFIS

SEQ ID NO: 163 - protein, 11 aa, Corononavirus-HKU1
EDRCFAYCRWC

SEQ ID NO: 164 - protein, 7 aa, Corononavirus-HKU1
IYFSYCR

SEQ ID NO: 165 - protein, 4 aa, Corononavirus-HKU1
FLCR

SEQ ID NO: 166 - protein, 5 aa, Corononavirus-HKU1
NFISV

SEQ ID NO: 167 - protein, 5 aa, Corononavirus-HKU1
KFVFS

SEQ ID NO: 168 - protein, 10 aa, Corononavirus-HKU1
YFCCTKFIWV

SEQ ID NO: 169 - protein, 8 aa, Corononavirus-HKU1
SATIACLL

SEQ ID NO: 170 - protein, 5 aa, Corononavirus-HKU1
FFNSM

SEQ ID NO: 171 - protein, 5 aa, Corononavirus-HKU1
MVCSC

SEQ ID NO: 172 - protein, 6 aa, Corononavirus-HKU1
RSIFFF

SEQ ID NO: 173 - protein, 13 aa, Corononavirus-HKU1
LLCECSLSYVAAY

SEQ ID NO: 174 - protein, 8 aa, Corononavirus-HKU1
MAVAGSMV

SEQ ID NO: 175 - protein, 7 aa, Corononavirus-HKU1
ISCWQTT

SEQ ID NO: 176 - protein, 7 aa, Corononavirus-HKU1
VSCSCFS

SEQ ID NO: 177 - protein, 5 aa, Corononavirus-HKU1
TIRCY

SEQ ID NO: 178 - protein, 9 aa, Corononavirus-HKU1
FYSCCFETS

SEQ ID NO: 179 - protein, 6 aa, Corononavirus-HKU1
FIRCNL

SEQ ID NO: 180 - protein, 5 aa, Corononavirus-HKU1
IRTYL

SEQ ID NO: 181 - protein, 7 aa, Corononavirus-HKU1
TRKSCWC

SEQ ID NO: 182 - protein, 11 aa, Corononavirus-HKU1
CCYAFWYISKD

SEQ ID NO: 183 - protein, 5 aa, Corononavirus-HKU1
NCPLY

SEQ ID NO: 184 - protein, 9 aa, Corononavirus-HKU1
IECTIFDLF

SEQ ID NO: 185 - protein, 4 aa, Corononavirus-HKU1
YSSE

SEQ ID NO: 186 - protein, 4 aa, Corononavirus-HKU1
CCCS

SEQ ID NO: 187 - protein, 22 aa, Corononavirus-HKU1
HVYGCRCRPLYTFEMWFTLPTL

SEQ ID NO: 188 - protein, 5 aa, Corononavirus-HKU1
KIYRC

SEQ ID NO: 189 - protein, 4 aa, Corononavirus-HKU1
WLFN

SEQ ID NO: 190 - protein, 4 aa, Corononavirus-HKU1
LLVS

SEQ ID NO: 191 - protein, 11 aa, Corononavirus-HKU1
KFNPDFYIYVD

SEQ ID NO: 192 - protein, 4 aa, Corononavirus-HKU1
LFFG

SEQ ID NO: 193 - protein, 4 aa, Corononavirus-HKU1
NGCL

SEQ ID NO: 194 - protein, 6 aa, Corononavirus-HKU1
SFTILL

SEQ ID NO: 195 - protein, 11 aa, Corononavirus-HKU1
VLYKTYYKGSV

SEQ ID NO: 196 - protein, 4 aa, Corononavirus-HKU1
RCLY

SEQ ID NO: 197 - protein, 4 aa, Corononavirus-HKU1
VSWT

SEQ ID NO: 198 - protein, 6 aa, Corononavirus-HKU1
YLCSIE

SEQ ID NO: 199 - protein, 6 aa, Corononavirus-HKU1
CRFAVC

SEQ ID NO: 200 - protein, 11 aa, Corononavirus-HKU1
VQSNSLACSYW

SEQ ID NO: 201 - protein, 5 aa, Corononavirus-HKU1
CCFGI

SEQ ID NO: 202 - protein, 7 aa, Corononavirus-HKU1
FICETLF

SEQ ID NO: 203 - protein, 7 aa, Corononavirus-HKU1
ACYLVLS

SEQ ID NO: 204 - protein, 9 aa, Corononavirus-HKU1
SIIEFSYLF

SEQ ID NO: 205 - protein, 4 aa, Corononavirus-HKU1
CFVC

SEQ ID NO: 206 - protein, 4 aa, Corononavirus-HKU1
GVTR

SEQ ID NO: 207 - protein, 10 aa, Corononavirus-HKU1
CGYFCYGIAD

SEQ ID NO: 208 - protein, 4 aa, Corononavirus-HKU1
VKGC

SEQ ID NO: 209 - protein, 7 aa, Corononavirus-HKU1
NRRCYYC

SEQ ID NO: 210 - protein, 5 aa, Corononavirus-HKU1
KFIFS

SEQ ID NO: 211 - protein, 9 aa, Corononavirus-HKU1
CLGYVFDRL

SEQ ID NO: 212 - protein, 6 aa, Corononavirus-HKU1
LCCLGC

SEQ ID NO: 213 - protein, 5 aa, Corononavirus-HKU1
IVTPS

SEQ ID NO: 214 - protein, 4 aa, Corononavirus-HKU1
ITNS

SEQ ID NO: 215 - protein, 7 aa, Corononavirus-HKU1
GIYTIWY

SEQ ID NO: 216 - protein, 13 aa, Corononavirus-HKU1
TYYYTYRFVMFKR

SEQ ID NO: 217 - protein, 6 aa, Corononavirus-HKU1
SNSFSS

SEQ ID NO: 218 - protein, 18 aa, Corononavirus-HKU1
SKSYRILWFFEVVVYLCF

SEQ ID NO: 219 - protein, 6 aa, Corononavirus-HKU1
FITFYK

SEQ ID NO: 220 - protein, 10 aa, Corononavirus-HKU1
NHFLYYRNSF

SEQ ID NO: 221 - protein, 6 aa, Corononavirus-HKU1
FVLFGS

SEQ ID NO: 222 - protein, 6 aa, Corononavirus-HKU1
KCFSDI

SEQ ID NO: 223 - protein, 19 aa, Corononavirus-HKU1
MEYIYKRFSCCSHCVFVLV

SEQ ID NO: 224 - protein, 8 aa, Corononavirus-HKU1
FFVYKCYF

SEQ ID NO: 225 - protein, 4 aa, Corononavirus-HKU1
LLSS

SEQ ID NO: 226 - protein, 23 aa, Corononavirus-HKU1
CFSYFCGKNCYVDKGYFWFGYNL

SEQ ID NO: 227 - protein, 10 aa, Corononavirus-HKU1
VRCRFYKSFL

SEQ ID NO: 228 - protein, 6 aa, Corononavirus-HKU1
IVSFWF

SEQ ID NO: 229 - protein, 13 aa, Corononavirus-HKU1
YVGYICSYRFCSV

SEQ ID NO: 230 - protein, 4 aa, Corononavirus-HKU1
TCFI

SEQ ID NO: 231 - protein, 6 aa, Corononavirus-HKU1
FSQINC

SEQ ID NO: 232 - protein, 29 aa, Corononavirus-HKU1
TRYWLFIIHSMVLSIILSYWFTIIYYMVA

SEQ ID NO: 233 - protein, 11 aa, Corononavirus-HKU1
FVYVRNYALVD

SEQ ID NO: 234 - protein, 6 aa, Corononavirus-HKU1
IYCICS

SEQ ID NO: 235 - protein, 18 aa, Corononavirus-HKU1
YVTCFCLVAVLYSCYCYV

SEQ ID NO: 236 - protein, 5 aa, Corononavirus-HKU1
SSWFY

SEQ ID NO: 237 - protein, 6 aa, Corononavirus-HKU1
AYCLWL

SEQ ID NO: 238 - protein, 7 aa, Corononavirus-HKU1
SWLFILL

SEQ ID NO: 239 - protein, 10 aa, Corononavirus-HKU1
YYCWWCNSLL

SEQ ID NO: 240 - protein, 7 aa, Corononavirus-HKU1
WWYWFLC

SEQ ID NO: 241 - protein, 6 aa, Corononavirus-HKU1
TSMELF

SEQ ID NO: 242 - protein, 4 aa, Corononavirus-HKU1
LPFF

SEQ ID NO: 243 - protein, 12 aa, Corononavirus-HKU1
HFYNCRSCYRTF

SEQ ID NO: 244 - protein, 6 aa, Corononavirus-HKU1
TTCKSN

SEQ ID NO: 245 - protein, 7 aa, Corononavirus-HKU1
CFTLCSY

SEQ ID NO: 246 - protein, 10 aa, Corononavirus-HKU1
ASWLYDAFVL

SEQ ID NO: 247 - protein, 7 aa, Corononavirus-HKU1
RWTACLR

SEQ ID NO: 248 - protein, 5 aa, Corononavirus-HKU1
FICRY

SEQ ID NO: 249 - protein, 4 aa, Corononavirus-HKU1
SVTF

SEQ ID NO: 250 - protein, 8 aa, Corononavirus-HKU1
FVCSCSRE

SEQ ID NO: 251 - protein, 13 aa, Corononavirus-HKU1
FSECCCVLCTIIV

SEQ ID NO: 252 - protein, 14 aa, Corononavirus-HKU1
AYITCRQKVNYYSL

SEQ ID NO: 253 - protein, 9 aa, Corononavirus-HKU1
WYLCNPDYV

SEQ ID NO: 254 - protein, 6 aa, Corononavirus-HKU1
YFYVSF

SEQ ID NO: 255 - protein, 6 aa, Corononavirus-HKU1
HCSCFS

SEQ ID NO: 256 - protein, 17 aa, Corononavirus-HKU1
RGCAIRKGFRYFCGMCT

SEQ ID NO: 257 - protein, 4 aa, Corononavirus-HKU1
MLFH

SEQ ID NO: 258 - protein, 5 aa, Corononavirus-HKU1
NKIYY

SEQ ID NO: 259 - protein, 13 aa, Corononavirus-HKU1
IYDICSSCWFGIY

SEQ ID NO: 260 - protein, 9 aa, Corononavirus-HKU1
QFGTYIFKE

SEQ ID NO: 261 - protein, 4 aa, Corononavirus-HKU1
YCSC

SEQ ID NO: 262 - protein, 9 aa, Corononavirus-HKU1
FRCSYTEWC

SEQ ID NO: 263 - protein, 4 aa, Corononavirus-HKU1
ACTG

SEQ ID NO: 264 - protein, 7 aa, Corononavirus-HKU1
YFLYMVY

SEQ ID NO: 265 - protein, 4 aa, Corononavirus-HKU1
STYC

SEQ ID NO: 266 - protein, 6 aa, Corononavirus-HKU1
IKKSMC

SEQ ID NO: 267 - protein, 9 aa, Corononavirus-HKU1
NWLEVKIDF

SEQ ID NO: 268 - protein, 14 aa, Corononavirus-HKU1
ARGKCPYSYNTLFT

SEQ ID NO: 269 - protein, 6 aa, Corononavirus-HKU1
RRCCIE

SEQ ID NO: 270 - protein, 8 aa, Corononavirus-HKU1
FVIYIIFC

SEQ ID NO: 271 - protein, 14 aa, Corononavirus-HKU1
FNLFYIIVGFIAYI

SEQ ID NO: 272 - protein, 7 aa, Corononavirus-HKU1
YSFACLC

SEQ ID NO: 273 - protein, 4 aa, Corononavirus-HKU1
RYFS

SEQ ID NO: 274 - protein, 4 aa, Corononavirus-HKU1
FMFC

SEQ ID NO: 275 - protein, 4 aa, Corononavirus-HKU1
IFPI

SEQ ID NO: 276 - protein, 9 aa, Corononavirus-HKU1
VHFWVCLLS

SEQ ID NO: 277 - protein, 12 aa, Corononavirus-HKU1
FYGLPYCSGSYG

SEQ ID NO: 278 - protein, 7 aa, Corononavirus-HKU1
RYRFYYV

SEQ ID NO: 279 - protein, 17 aa, Corononavirus-HKU1
SFETWLSCFTFFNLCIC

SEQ ID NO: 280 - protein, 12 aa, Corononavirus-HKU1
CSVLYTTYSDFL

SEQ ID NO: 281 - protein, 11 aa, Corononavirus-HKU1
WLCFIIFVYYV

SEQ ID NO: 282 - protein, 28 aa, Corononavirus-HKU1
WYTTSLLLFRWCYEECFFVYIFGSTYTL

SEQ ID NO: 283 - protein, 6 aa, Corononavirus-HKU1
WFYKIS

SEQ ID NO: 284 - protein, 14 aa, Corononavirus-HKU1
RYCTYCKNALYDLL

SEQ ID NO: 285 - protein, 4 aa, Corononavirus-HKU1
SGCM

SEQ ID NO: 286 - protein, 8 aa, Corononavirus-HKU1
IRRRGYMF

SEQ ID NO: 287 - protein, 5 aa, Corononavirus-HKU1
FLGFE

SEQ ID NO: 288 - protein, 8 aa, Corononavirus-HKU1
KYAWNFLW

SEQ ID NO: 289 - protein, 6 aa, Corononavirus-HKU1
FVLSIF

SEQ ID NO: 290 - protein, 12 aa, Corononavirus-HKU1
FNSSYRFLFSYC

SEQ ID NO: 291 - protein, 21 aa, Corononavirus-HKU1
FYFWSYIGYSCCLGFLLFNKT

SEQ ID NO: 292 - protein, 7 aa, Corononavirus-HKU1
ACFWRLY

SEQ ID NO: 293 - protein, 11 aa, Corononavirus-HKU1
CCSYKCCCLVY

SEQ ID NO: 294 - protein, 30 aa, Corononavirus-HKU1
FSYAFCFSSLSYLCMCLCLFLFLCNIVFSF

SEQ ID NO: 295 - protein, 39 aa, Corononavirus-HKU1
CNYAFAMDCYVWCYNAFLVLCHICSYGYCKPCFMVIFIL

SEQ ID NO: 296 - protein, 4 aa, Corononavirus-HKU1
ENWC

SEQ ID NO: 297 - protein, 10 aa, Corononavirus-HKU1
RNISYYFYDY

SEQ ID NO: 298 - protein, 4 aa, Corononavirus-HKU1
RFLL

SEQ ID NO: 299 - protein, 6 aa, Corononavirus-HKU1
IKEFCF

SEQ ID NO: 300 - protein, 4 aa, Corononavirus-HKU1
CCLQ

SEQ ID NO: 301 - protein, 5 aa, Corononavirus-HKU1
IFEFV

SEQ ID NO: 302 - protein, 4 aa, Corononavirus-HKU1
VSLL

SEQ ID NO: 303 - protein, 6 aa, Corononavirus-HKU1
NGYCCL

SEQ ID NO: 304 - protein, 8 aa, Corononavirus-HKU1
RSGVFSVS

SEQ ID NO: 305 - protein, 5 aa, Corononavirus-HKU1
SYGNI

SEQ ID NO: 306 - protein, 29 aa, Corononavirus-HKU1
CLIPTSYSICFYIFFAIRYCKDGISYVKN

SEQ ID NO: 307 - protein, 4 aa, Corononavirus-HKU1
TLYC

SEQ ID NO: 308 - protein, 4 aa, Corononavirus-HKU1
CYLW

SEQ ID NO: 309 - protein, 9 aa, Corononavirus-HKU1
YDFEWFMVR

SEQ ID NO: 310 - protein, 13 aa, Corononavirus-HKU1
QSLLSSSCYMFIL

SEQ ID NO: 311 - protein, 4 aa, Corononavirus-HKU1
YERT

SEQ ID NO: 312 - protein, 6 aa, Corononavirus-HKU1
LFCLIV

SEQ ID NO: 313 - protein, 4 aa, Corononavirus-HKU1
SYSR

SEQ ID NO: 314 - protein, 39 aa, Corononavirus-HKU1
FYYNVWSDEFNSCVLPDAGLSTCFDSLFTKSLHSKIYFW

SEQ ID NO: 315 - protein, 8 aa, Corononavirus-HKU1
NFYCFSCV

SEQ ID NO: 316 - protein, 12 aa, Corononavirus-HKU1
WPTTRGISCYYA

SEQ ID NO: 317 - protein, 17 aa, Corononavirus-HKU1
RFFFVWVMWICWLCINR

SEQ ID NO: 318 - protein, 17 aa, Corononavirus-HKU1
VCIYASIRAQYWLSHWH

SEQ ID NO: 319 - protein, 5 aa, Corononavirus-HKU1
FLWSI

SEQ ID NO: 320 - protein, 9 aa, Corononavirus-HKU1
RCSSCTVAS

SEQ ID NO: 321 - protein, 6 aa, Corononavirus-HKU1
GLRPDC

SEQ ID NO: 322 - protein, 10 aa, Corononavirus-HKU1
CYCLALCSYT

SEQ ID NO: 323 - protein, 7 aa, Corononavirus-HKU1
LCLVCTK

SEQ ID NO: 324 - protein, 4 aa, Corononavirus-HKU1
CLFY

SEQ ID NO: 325 - protein, 8 aa, Corononavirus-HKU1
CLGYGKWF

SEQ ID NO: 326 - protein, 19 aa, Corononavirus-HKU1
PSKSRSCLRCFGFNDRCFY

SEQ ID NO: 327 - protein, 6 aa, Corononavirus-HKU1
NFIGCY

SEQ ID NO: 328 - protein, 17 aa, Corononavirus-HKU1
ASIYGISRSSNTRKLYF

SEQ ID NO: 329 - protein, 4 aa, Corononavirus-HKU1
IGTF

SEQ ID NO: 330 - protein, 8 aa, Corononavirus-HKU1
RLSTIGWC

SEQ ID NO: 331 - protein, 5 aa, Corononavirus-HKU1
NKKIY

SEQ ID NO: 332 - protein, 13 aa, Corononavirus-HKU1
RNNLLDFDIYIFV

SEQ ID NO: 333 - protein, 7 aa, Corononavirus-HKU1
LYNFCIC

SEQ ID NO: 334 - protein, 7 aa, Corononavirus-HKU1
MDYIYVY

SEQ ID NO: 335 - protein, 14 aa, Corononavirus-HKU1
YTYDWCYIMCTLFC

SEQ ID NO: 336 - protein, 6 aa, Corononavirus-HKU1
FYDVTS

SEQ ID NO: 337 - protein, 24 aa, Corononavirus-HKU1
AFLFDYVYNSCTLYLVLCKLFSCL

SEQ ID NO: 338 - protein, 20 aa, Corononavirus-HKU1
RFYLCLALIFCSCCEFYLCL

SEQ ID NO: 339 - protein, 17 aa, Corononavirus-HKU1
SILWLYFMCFCYFYNYA

SEQ ID NO: 340 - protein, 9 aa, Corononavirus-HKU1
HFFFDVFGW

SEQ ID NO: 341 - protein, 44 aa, Corononavirus-HKU1
NSYFNFYVVFWVEFRRGCFVIYYSLFRYLYMDHYFVISYSKNCC

SEQ ID NO: 342 - protein, 4 aa, Corononavirus-HKU1
LVVC

SEQ ID NO: 343 - protein, 10 aa, Corononavirus-HKU1
YILFYRCTLY

SEQ ID NO: 344 - protein, 27 aa, Corononavirus-HKU1
IDSLELLIYRVYFILLLGIFLSFKQCF

SEQ ID NO: 345 - protein, 6 aa, Corononavirus-HKU1
NAYGCL

SEQ ID NO: 346 - protein, 11 aa, Corononavirus-HKU1
NFCSRIALYEC

SEQ ID NO: 347 - protein, 6 aa, Corononavirus-HKU1
WLTSTS

SEQ ID NO: 348 - protein, 17 aa, Corononavirus-HKU1
GYFVKFKTAWNRWRASY

SEQ ID NO: 349 - protein, 9 aa, Corononavirus-HKU1
SLPNSIKID

SEQ ID NO: 350 - protein, 4 aa, Corononavirus-HKU1
CEMC

SEQ ID NO: 351 - protein, 14 aa, Corononavirus-HKU1
CCFVKLFTAFACCF

SEQ ID NO: 352 - protein, 5 aa, Corononavirus-HKU1
VVAVL

SEQ ID NO: 353 - protein, 11 aa, Corononavirus-HKU1
NTIYFRFECSF

SEQ ID NO: 354 - protein, 15 aa, Corononavirus-HKU1
ACSIIDCFIRQSCCS

SEQ ID NO: 355 - protein, 6 aa, Corononavirus-HKU1
VSCKYR

SEQ ID NO: 356 - protein, 4 aa, Corononavirus-HKU1
LCSR

SEQ ID NO: 357 - protein, 8 aa, Corononavirus-HKU1
YRFAGFAK

SEQ ID NO: 358 - protein, 5 aa, Corononavirus-HKU1
VCKYG

SEQ ID NO: 359 - protein, 7 aa, Corononavirus-HKU1
SRKEKFG

SEQ ID NO: 360 - protein, 11 aa, Corononavirus-HKU1
STTDKTVRKSM

SEQ ID NO: 361 - protein, 6 aa, Corononavirus-HKU1
SCSSQT

SEQ ID NO: 362 - protein, 8 aa, Corononavirus-HKU1
TYGRPSTY

SEQ ID NO: 363 - protein, 4 aa, Corononavirus-HKU1
RGSD

SEQ ID NO: 364 - protein, 10 aa, Corononavirus-HKU1
SCFRFADNAF

SEQ ID NO: 365 - protein, 8 aa, Corononavirus-HKU1
SGFKFYSG

SEQ ID NO: 366 - protein, 13 aa, Corononavirus-HKU1
RLCTFECYSSIGC

SEQ ID NO: 367 - protein, 8 aa, Corononavirus-HKU1
YFNYSNTR

SEQ ID NO: 368 - protein, 7 aa, Corononavirus-HKU1
CLCYICW

SEQ ID NO: 369 - protein, 10 aa, Corononavirus-HKU1
CMAYTDCSRC

SEQ ID NO: 370 - protein, 10 aa, Corononavirus-HKU1
LASCYHCEQV

SEQ ID NO: 371 - protein, 5 aa, Corononavirus-HKU1
CCYAE

SEQ ID NO: 372 - protein, 4 aa, Corononavirus-HKU1
VDAS

SEQ ID NO: 373 - protein, 6 aa, Corononavirus-HKU1
IKNTSC

SEQ ID NO: 374 - protein, 7 aa, Corononavirus-HKU1
YSYSMLL

SEQ ID NO: 375 - protein, 6 aa, Corononavirus-HKU1
NSLCCS

SEQ ID NO: 376 - protein, 4 aa, Corononavirus-HKU1
DNER

SEQ ID NO: 377 - protein, 8 aa, Corononavirus-HKU1
WKLCCFRA

SEQ ID NO: 378 - protein, 6 aa, Corononavirus-HKU1
IFYTRC

SEQ ID NO: 379 - protein, 5 aa, Corononavirus-HKU1
VSLFY

SEQ ID NO: 380 - protein, 11 aa, Corononavirus-HKU1
RVGCWYFIFNN

SEQ ID NO: 381 - protein, 7 aa, Corononavirus-HKU1
IAGWCCY

SEQ ID NO: 382 - protein, 13 aa, Corononavirus-HKU1
FFYTFIMCIFCRS

SEQ ID NO: 383 - protein, 15 aa, Corononavirus-HKU1
ENLFRLYTTRWCTYN

SEQ ID NO: 384 - protein, 10 aa, Corononavirus-HKU1
SCWYWYGHYY

SEQ ID NO: 385 - protein, 26 aa, Corononavirus-HKU1
PRFLWWCLSLYLLPCTCRASRCRWYM

SEQ ID NO: 386 - protein, 18 aa, Corononavirus-HKU1
ICTSPFGYKRSYSLCVNT

SEQ ID NO: 387 - protein, 24 aa, Corononavirus-HKU1
CLSSLWFLERWQLFLCRFKCRCSI

SEQ ID NO: 388 - protein, 2723 aa, Corononavirus-HKU1
RFKFFKRVRGTSVNARLVPCASGLSTDVQLRAFDICNTNRAGIGLYYKVNCCRFQRIDDDGNKLDKFFVVKRTNLEVYNKEKTYYELTKSCGVVAEHDFFTFDIDGSRVPHIVRRNLSKYTMLDLCYALRHFDRNDCSILCEILCEYADCKESYFSKKDWYDFVENPDIINIYKKLGPIFNRALLNTVIFADTLVEVGLVGVLTLDNQDLYGQWYDFGDFIQTAPGFGVAVADSYYSYMMPMLTMCHVLDCELFVNDSYRQFDLVQYDFTDYKLELFNKYFKYWGMKYHPNTVDCDNDRCIIHCANFNILFSMVLPNTCFGPLVRQIFVDGVPFVVSIGYHYKELGVVMNLDVDTHRYRLSLKDLLLYAADPAMHVASASALLDLRTCCFSVAAITSGIKFQTVKPGNFNQDFYEFVKSKGLFKEGSTVDLKHFFFTQDGNAAITDYNYYKYNLPTMVDIKQLLFVLEVVYKYFEIYDGGCIPASQVIVNNYDKSAGYPFNKFGKARLYYEALSFEEQNEIYAYTKRNVLPTLTQMNLKYAISAKNRARTVAGVSILSTMTGRMFHQKCLKSIAATRGVPVVIGTTKFYGGWDDMLRHLIKDVDNPVLMGWDYPKCDRAMPNILRIVSSLVLARKHEFCCSHGDRFYRLANECAQVLSEIVMCGGCYYVKPGGTSSGDATTAFANSVFNICQAVTANVCSLMACNGHKIEDLSIRNLQKRLYSNVYRTDYVDYTFVNEYYEFLCKHFSMMILSDDGVVCYNSDYASKGYIANISVFQQVLYYQNNVFMSESKCWVENDITNGPHEFCSQHTMLVKIDGDYVYLPYPDPSRILGAGCFVDDLLKTDSVLLIERFVSLAIDAYPLVHHENEEYQKVFRVYLEYIKKLYNDLGTQILDSYSVILSTCDGLKFTEESFYKNMYLKSAVMQSVGACVVCSSQTSLRCGSCIRKPLLCCKCCYDHVMATNHKYVLSVSPYVCNAPNCDVSDVTKLYLGGMSYYCENHKPHYSFKLVMNGMVFGLYKQSCTGSPYIDDFNKIASCKWTEVDDYVLANECIERLKLFAAETQKATEEAFKQSYASATIQEIVSDREVILCWETGKVKPPLNKNYVFTGYHFTSTGKTVLGEYVFDKSELTNGVYYRATTTYKLSIGDVFVLTSHSVASLSAPTLVPQENYASIRFSSVYSVPLVFQNNVANYQHIGMKRYCTVQGPPGTGKSHLAIGLAVYYYTARVVYTAASHAAVDALCEKAYKFLNINDCTRIIPAKVRVDCYDKFKINDTTCKYVFTTINALPELVTDIVVVDEVSMLTNYELSVINARIKAKHYVYIGDPAQLPAPRVLLSKGSLEPRHFNSITKIMCCLGPDIFLGNCYRCPKEIVETVSALVYDNKLKAKNDNSSLCFKVYFKGQTTHESSSAVNIQQIYLISKFLKANPVWNSAVFISPYNSQNYVAKRVLGVQTQTVDSAQGSEYDYVIYSQTAETAHSVNVNRFNVAITRAKKGIFCVMSNMQLFESLNFITLPLDKIQNQTLPRLHCTTNLFKDCSKSCLGYHPAHAPSFLAVDDKYKVNENLAVNLNICEPVLTYSRLISLMGFKLDLTLDGYSKLFITKDEAIKRVRGWVGFDVEGAHATRENIGTNFPLQIGFSTGVDFVVEATGLFAERDCYTFKKTVAKAPPGEKFKHLIPLMSKGQKWDIVRIRIVQMLSDYLLDLSDSVVFITWSASFELTCLRYFAKLGRELNCNVCSNRATCYNSRTGYYGCWRHSYTCDYVYNPLIVDIQQWGYTGSLTSNHDIICNVHKGAHVASADAIMTRCLAIYDCFCKSVNWNLEYPIISNEVSINTSCRLLQRVMLKAAMLCNRYNLCYDIGNPKGLACVKDYEFKFYDAFPVAKSVKQLFYVYDVHKDNFKDGLCMFWNCNVDKYPSNSIVCRFDTRVLNKLNLPGCNGGSLYVNKHAFHTNPFTRTVFENLKPMPFFYYSDTPCVYVDGLESKQVDYVPLRSATCITRCNLGGAVCSKHAEEYCNYLESYNIVTTAGFTFWVYKNFDFYNLWNTFTTLQSLENVIYNLVNVGHYDGRTGELPCAIMNDKVVVKINNVDTVIFKNNTSFPTNIAVELFTKRSIRHHPELKILRNLNIDICWKHVLWDYVKDSLFCSSTYGVCKYTDLKFIENLNILFDGRDTGALEAFRKARNGVFISTEKLSRLSMIKGPQRADLNGVIVDKVGELKVEFWFAMRKDGDDVIFSRTDSLCSSHYWSPQGNLGGNCAGNVIGNDALTRFTIFTQSRVLSSFEPRSDLERDFIDMDDNLFIAKYGLEDYAFDHIVYGSFNHKVIGGLHLLIGLFRRKKKSNLLIQEFLQYDSSIHSYFITDQECGSSKSVCTVIDLLLDDFVSIVKSLNLSCVSKVVNINVDFKDFQFMLWCNDNKIMTFYPKMQATNDWKPGYSMPVLYKYLNVPLERVSLWNYGKPINLPTGCMMNVAKYTQLCQYLNTTTLAVPVNMRVLHLGAGSDKEVAPGSAVLRQWLPSGSILVDNDLNPFVSDSLVTYFGDCMTLPFDCHWDLIISDMYDPLTKNIGDYNVSKDGFFTYICHLIRDKLSLGGSVAIKITEFSWNADLYKLMSCFAFWTVFCTNVNASSSEGFLIGINYLGKSSFEIDGNVMHANYLFWRNSTTWNGGAYSLFDMTKFSLKLAGTAVVNLRPDQLNDLVYSLIERGKLLVRDTRKEIFVGDSLVNTC

SEQ ID NO: 389 - protein, 20 aa, Corononavirus-HKU1
ISLNLNYVNYFFIFLFLLWF

SEQ ID NO: 390 - protein, 7 aa, Corononavirus-HKU1
CCVSFKP

SEQ ID NO: 391 - protein, 5 aa, Corononavirus-HKU1
LVFIW

SEQ ID NO: 392 - protein, 6 aa, Corononavirus-HKU1
LFGYSP

SEQ ID NO: 393 - protein, 5 aa, Corononavirus-HKU1
FVQQW

SEQ ID NO: 394 - protein, 8 aa, Corononavirus-HKU1
EFSFHSIL

SEQ ID NO: 395 - protein, 5 aa, Corononavirus-HKU1
LHWRR

SEQ ID NO: 396 - protein, 5 aa, Corononavirus-HKU1
SNYFL

SEQ ID NO: 397 - protein, 4 aa, Corononavirus-HKU1
CMAS

SEQ ID NO: 398 - protein, 10 aa, Corononavirus-HKU1
QGKILSCLIF

SEQ ID NO: 399 - protein, 10 aa, Corononavirus-HKU1
YGLFSLSYFC

SEQ ID NO: 400 - protein, 4 aa, Corononavirus-HKU1
CFSF

SEQ ID NO: 401 - protein, 4 aa, Corononavirus-HKU1
YFIT

SEQ ID NO: 402 - protein, 5 aa, Corononavirus-HKU1
QSYFY

SEQ ID NO: 403 - protein, 19 aa, Corononavirus-HKU1
GSLFYFIRLFSLFSTALPF

SEQ ID NO: 404 - protein, 4 aa, Corononavirus-HKU1
SVLL

SEQ ID NO: 405 - protein, 10 aa, Corononavirus-HKU1
HRYWLCLWFF

SEQ ID NO: 406 - protein, 4 aa, Corononavirus-HKU1
CCLS

SEQ ID NO: 407 - protein, 8 aa, Corononavirus-HKU1
FRLYLYFS

SEQ ID NO: 408 - protein, 4 aa, Corononavirus-HKU1
TRFL

SEQ ID NO: 409 - protein, 12 aa, Corononavirus-HKU1
SFHHCTFFILTY

SEQ ID NO: 410 - protein, 4 aa, Corononavirus-HKU1
SSLF

SEQ ID NO: 411 - protein, 8 aa, Corononavirus-HKU1
TICTCTGC

SEQ ID NO: 412 - protein, 27 aa, Corononavirus-HKU1
MEQRACLRYFFICCMSIAILLFSQFFC

SEQ ID NO: 413 - protein, 5 aa, Corononavirus-HKU1
LCWQV

SEQ ID NO: 414 - protein, 11 aa, Corononavirus-HKU1
WFYFYFIWSFI

SEQ ID NO: 415 - protein, 12 aa, Corononavirus-HKU1
CFLYFILWCIFI

SEQ ID NO: 416 - protein, 11 aa, Corononavirus-HKU1
FYIHLALLFFW

SEQ ID NO: 417 - protein, 7 aa, Corononavirus-HKU1
VSYIFYY

SEQ ID NO: 418 - protein, 6 aa, Corononavirus-HKU1
TSNLCL

SEQ ID NO: 419 - protein, 26 aa, Corononavirus-HKU1
FFAYYFTRYFIMFSFTFCCFSIIFVI

SEQ ID NO: 420 - protein, 1362 aa, Corononavirus-HKU1
ISLNLNMLLIIFILPTTLAVIGDFNCTNFAINDLNTTVPRISEYVVDVSYGLGTYYILDRVYLNTTILFTGYFPKSGANFRDLSLKGTTYLSTLWYQKPFLSDFNNGIFSRVKNTKLYVNKTLYSEFSTIVIGSVFINNSYTIVVQPHNGVLEITACQYTMCEYPHTICKSKGSSRNESWHFDKSEPLCLFKKNFTYNVSTDWLYFHFYQERGTFYAYYADSGMPTTFLFSLYLGTLLSHYYVLPLTCNAISSNTDNETLQYWVTPLSKRQYLLKFDNRGVITNAVDCSSSFFSEIQCKTKSLLPNTGVYDLSGFTVKPVATVHRRIPDLPDCDIDKWLNNFNVPSPLNWERKIFSNCNFNLSTLLRLVHTDSFSCNNFDESKIYGSCFKSIVLDKFAIPNSRRSDLQLGSSGFLQSSNYKIDTTSSSCQLYYSLPAINVTINNYNPSSWNRRYGFNNFNLSSHSVVYSRYCFSVNNTFCPCAKPSFASSCKSHKPPSASCPIGTNYRSCESTTVLDHTDWCRCSCLPDPITAYDPRSCSQKKSLVGVGEHCAGFGVDEEKCGVLDGSYNVSCLCSTDAFLGWSYDTCVSNNRCNIFSNFILNGINSGTTCSNDLLQPNTEVFTDVCVDYDLYGITGQGIFKEVSAVYYNSWQNLLYDSNGNIIGFKDFVTNKTYNIFPCYAGRVSAAFHQNASSLALLYRNLKCSYVLNNISLTTQPYFDSYLGCVFNADNLTDYSVSSCALRMGSGFCVDYNSPSSSSSRRKRRSISASYRFVTFEPFNVSFVNDSIESVGGLYEIKIPTNFTIVGQEEFIQTNSPKVTIDCSLFVCSNYAACHDLLSEYGTFCDNINSILDEVNGLLDTTQLHVADTLMQGVTLSSNLNTNLHFDVDNINFKSLVGCLGPHCGSSSRSFFEDLLFDKVKLSDVGFVEAYNNCTGGSEIRDLLCVQSFNGIKVLPPILSESQISGYTTAATVAAMFPPWSAAAGIPFSLNVQYRINGLGVTMDVLNKNQKLIATAFNNALLSIQNGFSATNSALAKIQSVVNSNAQALNSLLQQLFNKFGAISSSLQEILSRLDALEAQVQIDRLINGRLTALNAYVSQQLSDISLVKFGAALAMEKVNECVKSQSPRINFCGNGNHILSLVQNAPYGLLFMHFSYKPISFKTVLVSPGLCISGDVGIAPKQGYFIKHNDHWMFTGSSYYYPEPISDKNVVFMNTCSVNFTKAPLVYLNHSVPKLSDFESELSHWFKNQTSIAPNLTLNLHTINATFLDLYYEMNLIQESIKSLNNSYINLKDIGTYEMYVKWPWYVWLLISFSFIIFLVLLFFICCCTGCGSACFSKCHNCCDEYGGHHDFVIKTSHDD

SEQ ID NO: 421 - protein, 39 aa, Corononavirus-HKU1
NLLSDLIKSKLYLWTFGDLATHILLLLENLVLQTLKICV

SEQ ID NO: 422 - protein, 15 aa, Corononavirus-HKU1
SIITVNLLLVTVLYL

SEQ ID NO: 423 - protein, 29 aa, Corononavirus-HKU1
MFGVASLANLLLTLHYVVTIFPIVIILVL

SEQ ID NO: 424 - protein, 16 aa, Corononavirus-HKU1
LVLLLMVILFLRLCLD

SEQ ID NO: 425 - protein, 99 aa, Corononavirus-HKU1
LNQLLNLLFGVQRHLISMVDLFFNDTAWYIGQILVLVLFCLISLIFVVAFLATIKLCMQLCGFCNFFIISPSAYVYKRGMQLYKSYSEQVIPPTSDYLI

SEQ ID NO: 426 - protein, 16 aa, Corononavirus-HKU1
INLFFLNLLLIKLLHS

SEQ ID NO: 427 - protein, 8 aa, Corononavirus-HKU1
KNGISLWV

SEQ ID NO: 428 - protein, 24 aa, Corononavirus-HKU1
YYFLLLSYCSSVIRAVVCLFILSR

SEQ ID NO: 429 - protein, 8 aa, Corononavirus-HKU1
LFFGLCGH

SEQ ID NO: 430 - protein, 8 aa, Corononavirus-HKU1
LYLIVFML

SEQ ID NO: 431 - protein, 8 aa, Corononavirus-HKU1
IMLFLHFL

SEQ ID NO: 432 - protein, 41 aa, Corononavirus-HKU1
CLLLFLLLYGFFILLIVFGFLLELAVGGVLIQRPIILCVLI

SEQ ID NO: 433 - protein, 15 aa, Corononavirus-HKU1
KARCLLGQLLRTITH

SEQ ID NO: 434 - protein, 30 aa, Corononavirus-HKU1
LLLLFVVIFIYRVSNLALVILFQICPYMLL

SEQ ID NO: 435 - protein, 13 aa, Corononavirus-HKU1
LRCKYFVPINVPF

SEQ ID NO: 436 - protein, 31 aa, Corononavirus-HKU1
MLIVVLLFLLSLKLVTIVYRLVNLVVWILPC

SEQ ID NO: 437 - protein, 220 aa, Corononavirus-HKU1
ELKSKLLGCLILPVIMLEVEAPLEIVQESSRKLLGLTNLSEITKPLIEAEKPNLNSLCLLNHKEILSHIIPGSPGSLNFKKVETLNFQMVKEFPLLSEYPLLKQKDIGIDTAGVLLKQLMVNKSSCYRDGISTISVPAHMPMHPMVNPSKGSSGLLITKLTLLLPPMFRQGILLLKKLSLLGFRLVRFCLKAIMLKAQEGLLLIVDQVHVLNHVDPIIVH

SEQ ID NO: 438 - protein, 12 aa, Corononavirus-HKU1
VEVILILDIQIL

SEQ ID NO: 439 - protein, 12 aa, Corononavirus-HKU1
NLIWLMRSLILF

SEQ ID NO: 440 - protein, 24 aa, Corononavirus-HKU1
PSLVKILNLSKSLSKMPRKSGIKF

SEQ ID NO: 441 - protein, 33 aa, Corononavirus-HKU1
QNLAKSELLINIVMFNSVLVKEDLLKILVMLKC

SEQ ID NO: 442 - protein, 14 aa, Corononavirus-HKU1
SLVLMILSFLFLQN

SEQ ID NO: 443 - protein, 12 aa, Corononavirus-HKU1
LLHQVLFSLVLN

SEQ ID NO: 444 - protein, 37 aa, Corononavirus-HKU1
TWLKEIPRLTHLLKMFLNFIILVLLGLIVLYQALRQL

SEQ ID NO: 445 - protein, 6 aa, Corononavirus-HKU1
KFLKRI

SEQ ID NO: 446 - protein, 14 aa, Corononavirus-HKU1
MLTLILIRTLILIR

SEQ ID NO: 447 - protein, 21 aa, Corononavirus-HKU1
VLNLSVKEVLNNYQNSLTLLI

SEQ ID NO: 448 - protein, 26 aa, Corononavirus-HKU1
VLVLSTFQMILLLRIIVYLLLLMILM

SEQ ID NO: 449 - protein, 10 aa, Corononavirus-HKU1
KTLLLNENES

SEQ ID NO: 450 - protein, 5 aa, Corononavirus-HKU1
FDTRW

SEQ ID NO: 451 - protein, 21 aa, Corononavirus-HKU1
PLAIIRNRTLSIRMNSCCNNR

SEQ ID NO: 452 - protein, 8 aa, Corononavirus-HKU1
SRLLQTIY

SEQ ID NO: 453 - protein, 9 aa, Corononavirus-HKU1
LVEILYLDI

SEQ ID NO: 454 - protein, 5 aa, Corononavirus-HKU1
GLAVV

SEQ ID NO: 455 - protein, 11 aa, Corononavirus-HKU1
TPPGRAINCSV

SEQ ID NO: 456 - protein, 18 aa, Corononavirus-HKU1
YMIEINYSLLEELQKKKK

SEQ ID NO: 457 - DNA, 29942 bp, Corononavirus-HKU1; identical to SEQ ID NO: 3
  CDS (2)..(29941)

SEQ ID NO: 458 - protein, 38 aa, Corononavirus-HKU1
NKSELRPYRLSAYDLLSDLIKSKLFKQDSLLSMLVSVV

SEQ ID NO: 459 - protein, 24 aa, Corononavirus-HKU1
SCILLSTLFISLPVTCWLSSASLP

SEQ ID NO: 460 - protein, 4473 aa, Corononavirus-HKU1
VAMIKTSKYGLGFKWAPEFRWLLPDAAEELASPMKSDEGGLCPSTGQAMESVGFVYDNHVKIDCRCILGQEWHVQSNLIRDIFVHEDLHVVEVLTKTAVKSGTAILIKSPLHSLGGFPKGYVMGLFRSYKTKRYVVHHLSMTTSTTNFGEDFLGWIVPFGFMPSYVHKWFQFCRLYIEESDLIISNFKFDDYDFSVEDAYAEVHAEPKGKYSQKAYALLRQYRGIKPVLFVDQYGCDYSGKLADCLQAYGHYSLQDMRQKQSVWLANCDFDIVVAWHVVRDSRFVMRLQTIATICGIKYVAQPTEDVVDGDVVIREPVHLLSADAIVLKLPSLMKVMTHMDDFSIKSIYNVDLCDCGFVMQYGYVDCFNDNCDFYGWVSGNMMDGFSCPLCCTVYDSSEVKAQSSGVIPENPVLFTNSTDTVNHDSFNLYGYSVTPFGSCIYWSPRPGLWIPIIKSSVKSYDDLVYSGVVGCKSIVKETALITHALYLDYVQCKCGNLEQNHILGVNNSWCRQLLLNRGDYNMLLKNIDLFVKRRADFACKFAVCGDGFVPFLLDGLIPRSYYLIQSGIFFTSLMSQFSQEVSDMCLKMCILFMDRVSVATFYIEHYVNRLVTQFKLLGTTLVNKMVNWFNTMLDASAPATGWLLYQLLNGLFVVSQANFNFVALIPDYAKILVNKFYTFFKLLLECVTVDVLKDMPVLKTINGLVCIVGNKFYNVSTGLIPGFVLPCNAQEQQIYFFEGVAESVIVEDDVIENVKSSLSSYEYCQPPKSVEKICIIDNMYMGKCGDKFFPIVMNDKNICLLDQAWRFPCAGRKVNFNEKPVVMEIPSLMTVKVMFDLDSTFDDILGKVCSEFEVEKGVTVDDFVAVVCDAIENALNSCKEHPVVGYQVRAFLNKLNENVVYLFDEAGDEAMASRMYCTFAIEDVEDVISSEAVEDTIDGVVEDTINDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNDDEDVVTGDNNDEEIVTGDNDDQIVVTGDDVDDIESIYDFDTYKALLVFNDVYNDALFVSYGSSVETETYFKVNGLWSPTITHTNCWLRSVLLVMQKLPFKFKDLAIENMWLSYKVGYNQSFVDYLLTTIPKAIVLPQGGFVADFAYWFLNQFDINAYANWCCLKCGFSFDLNGLDALFFYGDIVSHVCKCGHNMTLIAADLPCTLHFSLFDDNFCAFCTPKKIFIAACAVDVNVCHSVAVIGDEQIDGKFVTKFSGDKFDFIVGYGMSFSMSSFELPQLYGLCITPNVCFVKGDIINVARLVKADVIVNPANGHMLHGGGVAKAIAVAAGKKFSKETAAMVKSKGVCQVGDCYVSTGGKLCKTILNIVGPDARQDGRQSYVLLARAYKHLNNYDCCLSTLISAGIFSVPADVSLTYLLGVVDKQVILVSNNKEDFDIIQKCQITSVVGTKALAVRLTANVGRVIKFETDAYKLFLSGDDCFVSNSSVIQEVLLLRHDIQLNNDVRDYLLSKMTSLPKDWRLINKFDVINGVKTVKYFECPNSIYICSQGKDFGYVCDGSFYKATVNQVCVLLAKKIDVLLTVDGVNFKSISLTVGEVFGKILGNVFCDGIDVTKLKCSDFYADKILYQYENLSLADISAVQSSFGFDQQQLLAYYNFLTVCKWSVVVNGPFFSFEQSHNNCYVNVACLMLQHINLKFNKWQWQEAWYEFRAGRPHRLVALVLAKGHFKFDEPSDATDFIRVVLKQADLSGAICELELICDCGIKQESRVGVDAVMHFGTLAKTDLFNGYKIGCNCAGRIVHCTKLNVPFLICSNTPLSKDLPDDVVAANMFMGVGVGHYTHLKCGSPYQHYDACSVKKYTGVSGCLTDCLYLKNLTQTFTSMLTNYFLDDVEMVAYNPDLSQYYCDNGKYYTKPIIKAQFKPFAKVDGVYTNFKLVGHDICAQLNDKLGFNVDLPFVEYKVTVWPVATGDVVLASDDLYVKRYFKGCETFGKPVIWFCHDEASLNSLTYFNKPSFKSENRYSVLSVDSVSEESQGNVVTSVMESQISTKEVKLKGVRKTVKIEDAIIVNDENSSIKVVKSLSLVDVWDMYLTGCDYVVWVANELSRLVKSPTVREYIRYGIKPITIPIDLLCLRDDNQTLLVPKIFKARAIEFYGFLKWLFIYVFSLLHFTNDKTIFYTTEIASKFTFNLFCLALKNAFQTFRWSIFIKGFLVVATVFLFWFNFLYINVIFSDFYLPNISVFPIFVGRIVMWIKATFGLVTICDFYSKLGVGFTSHFCNGSFICELCHSGFDMLDTYAAIDFVQYEVDRRVLFDYVSLVKLIVELVIGYSLYTVWFYPLFCLIGLQLFTTWLPDLFMLETMHWLIRFIVFVANMLPAFVLLRFYIVVTAMYKVVGFIRHIVYGCNKAGCLFCYKRNCSVRVKCSTIVGGVIRYYDITANGGTGFCVKHQWNCFNCHSFKPGNTFITVEAAIELSKELKRPVNPTDASHYVVTDIKQVGCMMRLFYDRDGQRVYDDVDASLFVDINNLLHSKVKVVPNLYVVVVESDADRANFLNAVVFYAQSLYRPILLVDKKLITTACNGISVTQTMFDVYVDTFMSHFDVDRKSFNNFVNIAHASLREGVQLEKVLDTFVGCVRKCCSIDSDVETRFITKSMISAVAAGLEFTDENYNNLVPTYLKSDNIVAADLGVLIQNGAKHVQGNVAKAANISCIWFIDAFNQLTADLQHKLKKACVKTGLKLKLTFNKQEASVPILTTPFSLKGGVVLSNLLYILFFVSLICFILLWALLPTYSVYKSDIHLPAYASFKVIDNGVVRDISVNDLCFANKFFQFDQWYESTFGSVYYHNSMDCPIVVAVMDEDIGSTMFNVPTKVLRHGFHVLHFLTYAFASDSVQCYTPHIQISYNDFYASGCVLSSLCTMFKRGDGTPHPYCYSDGVMKNASLYTSLVPHTRYSLANSNGFIRFPDVISEGIVRIVRTRSMTYCRVGACEYAEEGICFNFNSSWVLNNDYYRSMPGTFCGRDLFDLFYQFFSSLIRPIDFFSLTASSIFGAILAIVVVLVFYYLIKLKRAFGDYTSVVVINVVVWCINFLMLFVFQVYPICACVYACFYFYVTLYFPSEISVIMHLQWIVMYGAIMPFWFCVTYVAMVIANHVLWLFSYCRKIGVNVCSDSTFEETSLTTFMITKDSYCRLKNSVSDVAYNRYLSLYNKYRYYSGKMDTAAYREAACSQLAKAMETFNHNNGNDVLYQPPTASVSTSFLQSGIVKMVSPTSKIEPCIVSVTYGSMTLNGLWLDDKVYCPRHVICSSSNMNEPDYSALLCRVTLGDFTIMSGRMSLTVVSYQMQGCQLVLTVSLQNPYTPKYTFGNVKPGETFTVLAAYNGRPQGAFHVTMRSSYTIKGSFLCGSCGSVGYVLTGDSVKFVYMHQLELSTGCHTGTDFTGNFYGPYRDAQVVQLPVKDYVQTVNVIAWLYAAILNNCAWFVQNDVCSTEDFNVWAMANGFSQVKADLVLDALASMTGVSIETLLAAIKRLYMGFQGRQILGSCTFEDELAPSDVYQQLAGVKLQSKTKRFIKETIYWILISTFLFSCIISAFVKWTIFMYINTHMIGVTLCVLCFVSFMMLLVKHKHFYLTMYIIPVLCTLFYVNYLVVYKEGFRGFTYVWLSYFVPAVNFTYVYEVFYGCILCVFAIFITMHSINHDIFSLMFLVGRIVTLISMWYFGSNLEEDVLLFITAFLGTYTWTTILSLAIAKIVANWLSVNIFYFTDVPYIKLILLSYLFIGYILSCYWGFFSLLNSVFRMPMGVYNYKISVQELRYMNANGLRPPRNSFEAILLNLKLLGIGGVPVIEVSQIQSKLTDVKCANVVLLNCLQHLHVASNSKLWQYCSVLHNEILSTSDLSVAFDKLAQLLIVLFANPAAVDTKCLASIDEVSDDYVQDSTVLQALQSEFVNMASFVEYEVAKKNLADAKNSGSVNQQQIKQLEKACNIAKSVYERDKAVARKLERMADLALTNMYKEARINDKKSKVVSALQTMLFSMVRKLDNQALNSILDNAVKGCVPLSAIPALAANTLTIVIPDKQVFDKVVDNVYVTYAGSVWHIQTVQDADGINKQLTDISVDSNWPLVIIANRYNEVANAVMQNNELMPHKLKIQVVNSGSDMNCNIPTQCYYNNGSSGRIVYAVLSDVDGLKYTKIMKDDGNCVVLELDPPCKFSIQDVKGLKIKYLYFIKGCNTLARGWVVGTLSSTIRLQAGVATEYAANSSILSLCAFSVDPKKTYLDYIQQGGVPIINCVKMLCDHAGTGMAITIKPEATINQDSYGGASVCIYCRARVEHPDVDGICKLRGKFVQVPLGIKDPILYVLTHDVCQVCGFWRDGSCSCVGSSVAVQSKDLNFLNGFGVLV

SEQ ID NO: 461 - protein, 12 aa, Corononavirus-HKU1
YPVLVVYLLMFN

SEQ ID NO: 462 - protein, 12 aa, Corononavirus-HKU1
GHLTFVIPIELV

SEQ ID NO: 463 - protein, 5 aa, Corononavirus-HKU1
VYIIK

SEQ ID NO: 464 - protein, 7 aa, Corononavirus-HKU1
IVAVFSV

SEQ ID NO: 465 - protein, 17 aa, Corononavirus-HKU1
MTTVINWISSLLSKELI

SEQ ID NO: 466 - protein, 11 aa, Corononavirus-HKU1
KFIIKRKLIMS

SEQ ID NO: 467 - protein, 24 aa, Corononavirus-HKU1
LKVVVLWLNMISLHLILMVVACHI

SEQ ID NO: 468 - protein, 10 aa, Corononavirus-HKU1
FVGIFQSILC

SEQ ID NO: 469 - protein, 52 aa, Corononavirus-HKU1
IFAMHCVILIVMIVQYCVKFFVSMLIVKNPTFLRKIGMILLKILILLIYIKN

SEQ ID NO: 470 - protein, 17 aa, Corononavirus-HKU1
ALFLIELYLILSFLQTP

SEQ ID NO: 471 - protein, 33 aa, Corononavirus-HKU1
ITKICMVNGMILVILYKQPQGLVWQLQILTILI

SEQ ID NO: 472 - protein, 5 aa, Corononavirus-HKU1
LCVMY

SEQ ID NO: 473 - protein, 24 aa, Corononavirus-HKU1
IVNYLLMIVIDNSILYSMILLITS

SEQ ID NO: 474 - protein, 11 aa, Corononavirus-HKU1
SCLISILSIGV

SEQ ID NO: 475 - protein, 42 aa, Corononavirus-HKU1
SIILILWIVIMIGVLFIVLILIYYLVWFYLILVLVPLLDKFL

SEQ ID NO: 476 - protein, 15 aa, Corononavirus-HKU1
MVYRLLFLLVTITKS

SEQ ID NO: 477 - protein, 40 aa, Corononavirus-HKU1
MLTHTVIVCLLKIYFFMQQILLCTLHLLVLCLIYELVVLV

SEQ ID NO: 478 - protein, 6 aa, Corononavirus-HKU1
LPLQVV

SEQ ID NO: 479 - protein, 4 aa, Corononavirus-HKU1
NFKL

SEQ ID NO: 480 - protein, 26 aa, Corononavirus-HKU1
NQVTLTKTFTSLLKVKACLKRVVQLI

SEQ ID NO: 481 - protein, 35 aa, Corononavirus-HKU1
NIFSLLKMVMLQLLIIIIISIIYLLWLILSSYCLY

SEQ ID NO: 482 - protein, 65 aa, Corononavirus-HKU1
KLFINILKFMMVVVYQHHKLLLIIMIKVLVIHLINLVKPDFIMRHYHLRNRMKFMHILNVMFCPP

SEQ ID NO: 483 - protein, 12 aa, Corononavirus-HKU1
NMLSVLRIELAL

SEQ ID NO: 484 - protein, 8 aa, Corononavirus-HKU1
QVFLFLVL

SEQ ID NO: 485 - protein, 9 aa, Corononavirus-HKU1
QAECSIKNV

SEQ ID NO: 486 - protein, 9 aa, Corononavirus-HKU1
QLPEVFLLL

SEQ ID NO: 487 - protein, 16 aa, Corononavirus-HKU1
EPLNFMVVGTICYVIL

SEQ ID NO: 488 - protein, 29 aa, Corononavirus-HKU1
RMLTTLFLWVGIILNVIVLCQIFCVLLVV

SEQ ID NO: 489 - protein, 26 aa, Corononavirus-HKU1
FWPANMNFVVHMVIDFIALRMNVLKF

SEQ ID NO: 490 - protein, 51 aa, Corononavirus-HKU1
LCVAVAIMLSLVVLAVVMQLLLLLILFLIYVRLLLLMFVLLWPVMAIRLKI

SEQ ID NO: 491 - protein, 36 aa, Corononavirus-HKU1
VYAIYKNAYTLMFIVQIMLIIHLLMSIMNFYVSILV

SEQ ID NO: 492 - protein, 17 aa, Corononavirus-HKU1
VMMVLSVITLIMLVRVI

SEQ ID NO: 493 - protein, 39 aa, Corononavirus-HKU1
VFFNKFCTIRIMSLCLNLNVGLKMILLMVLMNFVPNILC

SEQ ID NO: 494 - protein, 15 aa, Corononavirus-HKU1
MVIMFIYHIQILLEF

SEQ ID NO: 495 - protein, 9 aa, Corononavirus-HKU1
ELVVLLMIY

SEQ ID NO: 496 - protein, 6 aa, Corononavirus-HKU1
RLTVFF

SEQ ID NO: 497 - protein, 4 aa, Corononavirus-HKU1
MLTL

SEQ ID NO: 498 - protein, 15 aa, Corononavirus-HKU1
YIMKMKNTKKSFVYI

SEQ ID NO: 499 - protein, 11 aa, Corononavirus-HKU1
KNCIMILVLRS

SEQ ID NO: 500 - protein, 6 aa, Corononavirus-HKU1
IVIVLF

SEQ ID NO: 501 - protein, 5 aa, Corononavirus-HKU1
VLVMV

SEQ ID NO: 502 - protein, 12 aa, Corononavirus-HKU1
SLLKNHFTRICI

SEQ ID NO: 503 - protein, 40 aa, Corononavirus-HKU1
VHALFVHHKLLCVVAVVYVSLCYVVNVVMTMLWQLIINMF

SEQ ID NO: 504 - protein, 13 aa, Corononavirus-HKU1
VSHLTFVMHLTVM

SEQ ID NO: 505 - protein, 25 aa, Corononavirus-HKU1
VMSPNYIWAVCLTIVKTINPIIHLS

SEQ ID NO: 506 - protein, 17 aa, Corononavirus-HKU1
MVWSLVCINNLARVHLI

SEQ ID NO: 507 - protein, 5 aa, Corononavirus-HKU1
MILIR

SEQ ID NO: 508 - protein, 20 aa, Corononavirus-HKU1
LVVNGQKLMIMFWQMSVLNV

SEQ ID NO: 509 - protein, 64 aa, Corononavirus-HKU1
SYLLQKLKRQLKRLLNKAMLLLPFKRLLVIEKLFCVGRQVKLNHHLIKIMFSQATILLVLVRQF

SEQ ID NO: 510 - protein, 9 aa, Corononavirus-HKU1
VSMFLIKVN

SEQ ID NO: 511 - protein, 15 aa, Corononavirus-HKU1
LTVCITALQLLINFL

SEQ ID NO: 512 - protein, 5 aa, Corononavirus-HKU1
VMFLF

SEQ ID NO: 513 - protein, 4 aa, Corononavirus-HKU1
HHIL

SEQ ID NO: 514 - protein, 13 aa, Corononavirus-HKU1
VHLHLSHKRTMLV

SEQ ID NO: 515 - protein, 23 aa, Corononavirus-HKU1
DFLVFIVFHWCFKIMLLIISTLE

SEQ ID NO: 516 - protein, 18 aa, Corononavirus-HKU1
NVIALFKVPLVRESLILL

SEQ ID NO: 517 - protein, 8 aa, Corononavirus-HKU1
LFITTQHV

SEQ ID NO: 518 - protein, 9 aa, Corononavirus-HKU1
FILLLVMLL

SEQ ID NO: 519 - protein, 10 aa, Corononavirus-HKU1
MHCVKKLISF

SEQ ID NO: 520 - protein, 14 aa, Corononavirus-HKU1
ILTIVHVLFLLKFV

SEQ ID NO: 521 - protein, 19 aa, Corononavirus-HKU1
IVMISLKLMIPLVSMFLPQ

SEQ ID NO: 522 - protein, 26 aa, Corononavirus-HKU1
MHYQSWLQILLLLMKLVCLLIMNCLL

SEQ ID NO: 523 - protein, 24 aa, Corononavirus-HKU1
MLVLKLNIMYILEILLNYLHHVCC

SEQ ID NO: 524 - protein, 4 aa, Corononavirus-HKU1
ARVL

SEQ ID NO: 525 - protein, 10 aa, Corononavirus-HKU1
NLGTSILLLK

SEQ ID NO: 526 - protein, 16 aa, Corononavirus-HKU1
VLISFWEIVIGVLKKL

SEQ ID NO: 527 - protein, 38 aa, Corononavirus-HKU1
KLFQHWFMIINSRLKMIIVHYVLKYILRDRQHMRVQVL

SEQ ID NO: 528 - protein, 6 aa, Corononavirus-HKU1
IFNRYI

SEQ ID NO: 529 - protein, 4 aa, Corononavirus-HKU1
LVNF

SEQ ID NO: 530 - protein, 25 aa, Corononavirus-HKU1
KLIQFGIVLFLLVLIIVRIMLLSVF

SEQ ID NO: 531 - protein, 6 aa, Corononavirus-HKU1
VFKHKL

SEQ ID NO: 532 - protein, 31 aa, Corononavirus-HKU1
ILLKVRNMIMLYIHKQQKQPILLMLIDLMLP

SEQ ID NO: 533 - protein, 10 aa, Corononavirus-HKU1
LEPRRAFFVL

SEQ ID NO: 534 - protein, 15 aa, Corononavirus-HKU1
VICNYLNLLILLLYL

SEQ ID NO: 535 - protein, 25 aa, Corononavirus-HKU1
IKFKIKLYLVCIAQLIFLKIVVKVA

SEQ ID NO: 536 - protein, 10 aa, Corononavirus-HKU1
VIIQRMPPHF

SEQ ID NO: 537 - protein, 13 aa, Corononavirus-HKU1
QLMINIRLMKIWL

SEQ ID NO: 538 - protein, 6 aa, Corononavirus-HKU1
IFVNLF

SEQ ID NO: 539 - protein, 4 aa, Corononavirus-HKU1
HILV

SEQ ID NO: 540 - protein, 7 aa, Corononavirus-HKU1
YLLWVLN

SEQ ID NO: 541 - protein, 44 aa, Corononavirus-HKU1
LLMVILNCLLLKMKPLNVLEVGLVLMLRALMLLAKTLEQTFHCK

SEQ ID NO: 542 - protein, 8 aa, Corononavirus-HKU1
VFQLVWIL

SEQ ID NO: 543 - protein, 18 aa, Corononavirus-HKU1
LKLLAYLLREIVILLKKL

SEQ ID NO: 544 - protein, 11 aa, Corononavirus-HKU1
LKLLLVKNLNI

SEQ ID NO: 545 - protein, 25 aa, Corononavirus-HKU1
YPLCQKVKSGILLELELFKCYLIIF

SEQ ID NO: 546 - protein, 5 aa, Corononavirus-HKU1
TFLIV

SEQ ID NO: 547 - protein, 13 aa, Corononavirus-HKU1
YLLLGLPVLNLLV

SEQ ID NO: 548 - protein, 5 aa, Corononavirus-HKU1
GILLN

SEQ ID NO: 549 - protein, 40 aa, Corononavirus-HKU1
AESLIVMCVLIVLHATILELVIMVVGAIVILVIMCIIHLL

SEQ ID NO: 550 - protein, 10 aa, Corononavirus-HKU1
IYNSGVIQVL

SEQ ID NO: 551 - protein, 5 aa, Corononavirus-HKU1
LVITI

SEQ ID NO: 552 - protein, 16 aa, Corononavirus-HKU1
FVMYIKVHMLRQLMQL

SEQ ID NO: 553 - protein, 13 aa, Corononavirus-HKU1
QSMIVFVNLLIGI

SEQ ID NO: 554 - protein, 6 aa, Corononavirus-HKU1
FLMRSV

SEQ ID NO: 555 - protein, 26 aa, Corononavirus-HKU1
IHLVGYCSVSCLKLPCYVIDTTYVMT

SEQ ID NO: 556 - protein, 5 aa, Corononavirus-HKU1
AILKV

SEQ ID NO: 557 - protein, 15 aa, Corononavirus-HKU1
LVSKIMNLNFMMLFL

SEQ ID NO: 558 - protein, 46 aa, Corononavirus-HKU1
PSLLNSYFMSMMCIKIILKMVYVCFGIVMLINIHLIQLFVDLTLEC

SEQ ID NO: 559 - protein, 45 aa, Corononavirus-HKU1
TFLDVMVVVCMLINMHSILILLLELFLKILSLCLFSIIQIRLVCT

SEQ ID NO: 560 - protein, 9 aa, Corononavirus-HKU1
NLNKLITFL

SEQ ID NO: 561 - protein, 10 aa, Corononavirus-HKU1
EAPLVSHGVI

SEQ ID NO: 562 - protein, 20 aa, Corononavirus-HKU1
VELFVQSMLKNIVTTLSLII

SEQ ID NO: 563 - protein, 28 aa, Corononavirus-HKU1
LLQQALLFGFIRILIFIIYGTLLLRYRV

SEQ ID NO: 564 - protein, 21 aa, Corononavirus-HKU1
YITWLMLVIMMDVQVNYLVLL

SEQ ID NO: 565 - protein, 10 aa, Corononavirus-HKU1
MTKLLLRLIM

SEQ ID NO: 566 - protein, 14 aa, Corononavirus-HKU1
ILLFLKIIHHFLLI

SEQ ID NO: 567 - protein, 21 aa, Corononavirus-HKU1
LLNCLQNVVSGTTLNLRFLEI

SEQ ID NO: 568 - protein, 31 aa, Corononavirus-HKU1
TLIFVGSMSCGIMLKIVCFVVPLMVFVNTQI

SEQ ID NO: 569 - protein, 5 aa, Corononavirus-HKU1
SSSKI

SEQ ID NO: 570 - protein, 11 aa, Corononavirus-HKU1
IYFLMVVTLAL

SEQ ID NO: 571 - protein, 16 aa, Corononavirus-HKU1
KLLEKQEMVFLLVLKN

SEQ ID NO: 572 - protein, 4 aa, Corononavirus-HKU1
VGYQ

SEQ ID NO: 573 - protein, 8 aa, Corononavirus-HKU1
LKVRNELI

SEQ ID NO: 574 - protein, 15 aa, Corononavirus-HKU1
LWIKLENSKLSFGSL

SEQ ID NO: 575 - protein, 26 aa, Corononavirus-HKU1
EKMVTMLSSAEQTAYAQAITGAHKVI

SEQ ID NO: 576 - protein, 13 aa, Corononavirus-HKU1
VVIARVMSLVMML

SEQ ID NO: 577 - protein, 20 aa, Corononavirus-HKU1
HVLLSLLRVVYCQVLNLAQI

SEQ ID NO: 578 - protein, 17 aa, Corononavirus-HKU1
NGILLIWMIICLLLNMV

SEQ ID NO: 579 - protein, 7 aa, Corononavirus-HKU1
KTMHLII

SEQ ID NO: 580 - protein, 9 aa, Corononavirus-HKU1
FMVVLTIKL

SEQ ID NO: 581 - protein, 6 aa, Corononavirus-HKU1
EVCICL

SEQ ID NO: 582 - protein, 11 aa, Corononavirus-HKU1
AYFVGKKNLIC

SEQ ID NO: 583 - protein, 34 aa, Corononavirus-HKU1
FKSFYSMILVFIHILLLIRSVVVVRVFVQLLIYY

SEQ ID NO: 584 - protein, 9 aa, Corononavirus-HKU1
MILFLLLSH

SEQ ID NO: 585 - protein, 27 aa, Corononavirus-HKU1
VVLVKLLILMLILRIFNLCCGVMIIKL

SEQ ID NO: 586 - protein, 24 aa, Corononavirus-HKU1
LFILKCKPLMIGNLAILCLFCISI

SEQ ID NO: 587 - protein, 18 aa, Corononavirus-HKU1
RESLYGIMVNLLICLQAV

SEQ ID NO: 588 - protein, 11 aa, Corononavirus-HKU1
MLLSTLNYVSI

SEQ ID NO: 589 - protein, 4 aa, Corononavirus-HKU1
ILQH

SEQ ID NO: 590 - protein, 10 aa, Corononavirus-HKU1
LFLLICVFYI

SEQ ID NO: 591 - protein, 7 aa, Corononavirus-HKU1
VQGLIKK

SEQ ID NO: 592 - protein, 6 aa, Corononavirus-HKU1
LQVLLF

SEQ ID NO: 593 - protein, 10 aa, Corononavirus-HKU1
DSGYHLVVFL

SEQ ID NO: 594 - protein, 7 aa, Corononavirus-HKU1
THLLAIV

SEQ ID NO: 595 - protein, 7 aa, Corononavirus-HKU1
LLILEIV

SEQ ID NO: 596 - protein, 9 aa, Corononavirus-HKU1
LYHLIVIGI

SEQ ID NO: 597 - protein, 16 aa, Corononavirus-HKU1
YLICMILLLKILVIIM

SEQ ID NO: 598 - protein, 11 aa, Corononavirus-HKU1
VRMGFLLTFVI

SEQ ID NO: 599 - protein, 10 aa, Corononavirus-HKU1
FVINYLWVVV

SEQ ID NO: 600 - protein, 13 aa, Corononavirus-HKU1
KLQSFLGMLIYIN

SEQ ID NO: 601 - protein, 12 aa, Corononavirus-HKU1
VVLHFGQFFVLM

SEQ ID NO: 602 - protein, 8 aa, Corononavirus-HKU1
MLLLVKGF

SEQ ID NO: 603 - protein, 9 aa, Corononavirus-HKU1
ITWVNLLLK

SEQ ID NO: 604 - protein, 27 aa, Corononavirus-HKU1
MAMLCMLTICFGEIVQHGMAVLIVYLI

SEQ ID NO: 605 - protein, 4 aa, Corononavirus-HKU1
LNFL

SEQ ID NO: 606 - protein, 9 aa, Corononavirus-HKU1
NWLALLLLI

SEQ ID NO: 607 - protein, 4 aa, Corononavirus-HKU1
DQIN

SEQ ID NO: 608 - protein, 10 aa, Corononavirus-HKU1
FILLLKEVNY

SEQ ID NO: 609 - protein, 14 aa, Corononavirus-HKU1
FAIRVKRFLLVIVL

SEQ ID NO: 610 - protein, 6 aa, Corononavirus-HKU1
ILVRSH

SEQ ID NO: 611 - protein, 387 aa, Corononavirus-HKU1
TMLIIFLFFYFCYGFNEPLNVVSHLNHDWFLFGDSRSDCNHINNLKIKNFDYLDIHPSLCNNGKISSSAGDSIFKSFHFTRFYNYTGEGDQIIFYEGVNFNPYHRFKCFPNGSNDVWLLNKVRFYRALYSNMAFFRYLTFVDIPYNVSLSKFNSCKSDILSLNNPIFINYSKEVYFTLLGCSLYLVPLCLFKSNFSQYYYNIDTGSVYGFSNVVYPDLDCIYISLKPGSYKVSTTAPFLSLPTKALCFDKSKQFVPVQVVDSRWNNERASDISLSVACQLPYCYFRNSSANYVGKYDINHGDSGFISILSGLLYNVSCISYYGVFLYDNFTSIWPYYSFGRCPTSSIIKHPICVYDFLPIILQGILLCLALLFVVFLLFLLYNDKSH

SEQ ID NO: 612 - protein, 8 aa, Corononavirus-HKU1
LFLFCLQH

SEQ ID NO: 613 - protein, 12 aa, Corononavirus-HKU1
VILIVLILLLMI

SEQ ID NO: 614 - protein, 6 aa, Corononavirus-HKU1
TPQFLA

SEQ ID NO: 615 - protein, 21 aa, Corononavirus-HKU1
VSMLWMFLMVWVHIIYLIVFI

SEQ ID NO: 616 - protein, 21 aa, Corononavirus-HKU1
ILLYYLLVISLNLVPILGIYL

SEQ ID NO: 617 - protein, 5 aa, Corononavirus-HKU1
KVLHI

SEQ ID NO: 618 - protein, 38 aa, Corononavirus-HKU1
VLFGIRNPFYLILIMVFFLELRILSCMLIKLCIVSLVL

SEQ ID NO: 619 - protein, 113 aa, Corononavirus-HKU1
VVFLLTTLILLLFNLIMVFWRLQLVNTLCVSILILFVNLKVVLVMNLGILINLNLCVCSRKILLIMFLQIGCIFIFIKNVALFMLIMLILACLLLFYLVCILVLFYLIIMFCL

SEQ ID NO: 620 - protein, 115 aa, Corononavirus-HKU1
LVMLYLLILIMRLYNIGSHLCLNANIFLNLTTVVLLLMLLIVLVVSLARFNVKLNLYYLILVFMTYLVLLLSLLQLYIVVFLIYLIVTLINGLTILMYPHLLIGNVKFFLIATLI

SEQ ID NO: 621 - protein, 5 aa, Corononavirus-HKU1
VLCFV

SEQ ID NO: 622 - protein, 25 aa, Corononavirus-HKU1
FILILFLVIILMNLRYMVVVLRVLF

SEQ ID NO: 623 - protein, 66 aa, Corononavirus-HKU1
INLPYPTPDDLICSWAVLVFCNLLIIKLTLLLVLVNCIIVCLQLMLLLIIIILLLGIEGMVLIILI

SEQ ID NO: 624 - protein, 69 aa, Corononavirus-HKU1
ALIVLFTHVIVFLLIILFVLVLNLLLLQVARVINHLLLPVLLVLIIVLVRVLLYSTTLTGVGVLVYLIL

SEQ ID NO: 625 - protein, 49 aa, Corononavirus-HKU1
LLMTLGLVLKKSLWLVLVNIVQGSVLMKKSVVYWMDHIMFLVFVVLMPF

SEQ ID NO: 626 - protein, 20 aa, Corononavirus-HKU1
VGLMTLASVTTVVIFFLILF

SEQ ID NO: 627 - protein, 100 aa, Corononavirus-HKU1
MVSIVVPLVLMIYCSLILKFLLMFVLITTFMVLQDKVFLKKFLLFIIIVGKIFCMILMATLLVLKILLLIKHIIFSLVMQEEFLLLFIKMLPLWLYFIVI

SEQ ID NO: 628 - protein, 5 aa, Corononavirus-HKU1
NVAMF

SEQ ID NO: 629 - protein, 4 aa, Corononavirus-HKU1
IIFL

SEQ ID NO: 630 - protein, 18 aa, Corononavirus-HKU1
LLSHILIVILVAFLMLII

SEQ ID NO: 631 - protein, 72 aa, Corononavirus-HKU1
LIILFLLVLFAWVVVFVLIITHLLLPLRVVNVEVFLLLIVLLLLNPLMSVLLMTVLSLWVVFMRSKFPLTLL

SEQ ID NO: 632 - protein, 46 aa, Corononavirus-HKU1
LVKRNLFKLILLKLLLIVLYLSVLIMQLAMTYCQSMALFVIILIVF

SEQ ID NO: 633 - protein, 13 aa, Corononavirus-HKU1
MKLMVYLILLNCM

SEQ ID NO: 634 - protein, 29 aa, Corononavirus-HKU1
LILLCKVSHLAPILILICILMLIILILNP

SEQ ID NO: 635 - protein, 111 aa, Corononavirus-HKU1
VHTAVLLLVLFLKIYCLTKLNFQMLVLLKLITIVLVVVKLEIFFVYNPLMVLKFCLLFCLNLKFLVTPQPLLLLLCFHHGQQQLAYHFLLMYNIELMVWVLLWMFLIKIKS

SEQ ID NO: 636 - protein, 63 aa, Corononavirus-HKU1
LLLLIMLFFLFRMVLVLPTLHLLKYKVLLILMLKHLIVCYSNYLINLVQLVLLYKKFYLVSML

SEQ ID NO: 637 - protein, 13 aa, Corononavirus-HKU1
RLRFRLIGLLMVV

SEQ ID NO: 638 - protein, 13 aa, Corononavirus-HKU1
MLMSLNSLVIFLL

SEQ ID NO: 639 - protein, 5 aa, Corononavirus-HKU1
NLVLL

SEQ ID NO: 640 - protein, 27 aa, Corononavirus-HKU1
LWRRLMSVLKVNLLVLIFVVMVIIFCH

SEQ ID NO: 641 - protein, 23 aa, Corononavirus-HKU1
FKMLLMVCCLCILVINLFLLKLF

SEQ ID NO: 642 - protein, 9 aa, Corononavirus-HKU1
VLVCVYQVM

SEQ ID NO: 643 - protein, 36 aa, Corononavirus-HKU1
VLHLNKGILLNIMIIGCSLVVLTIILNQFQIKMLFL

SEQ ID NO: 644 - protein, 14 aa, Corononavirus-HKU1
ILVLLILLKRLLFI

SEQ ID NO: 645 - protein, 27 aa, Corononavirus-HKU1
IILYQNCLILNLSYLIGLKIKHPLRLI

SEQ ID NO: 646 - protein, 9 aa, Corononavirus-HKU1
IFILLMLLF

SEQ ID NO: 647 - protein, 5 aa, Corononavirus-HKU1
ICIMR

SEQ ID NO: 648 - protein, 9 aa, Corononavirus-HKU1
ILFKSLLSL

SEQ ID NO: 649 - protein, 9 aa, Corononavirus-HKU1
IIVISILKI

SEQ ID NO: 650 - protein, 6 aa, Corononavirus-HKU1
VHMKCM

SEQ ID NO: 651 - protein, 8 aa, Corononavirus-HKU1
NGLGMFGY

SEQ ID NO: 652 - protein, 5 aa, Corononavirus-HKU1
FLFHL

SEQ ID NO: 653 - protein, 63 aa, Corononavirus-HKU1
YSLYCSFLYVVVLVVVLHVLVNVIIVVMSMVVIMILLSKHLMMIRISCQISLNLNFIYGRLET

SEQ ID NO: 654 - protein, 7 aa, Corononavirus-HKU1
LHTFSCY

SEQ ID NO: 655 - protein, 7 aa, Corononavirus-HKU1
RIWCYKP

SEQ ID NO: 656 - protein, 6 aa, Corononavirus-HKU1
RFVSKV

SEQ ID NO: 657 - protein, 30 aa, Corononavirus-HKU1
LLSTYCWLLYCTFKCLVSQVWQICFSLYIT

SEQ ID NO: 658 - protein, 5 aa, Corononavirus-HKU1
SRYFP

SEQ ID NO: 659 - protein, 5 aa, Corononavirus-HKU1
FWCCN

SEQ ID NO: 660 - protein, 5 aa, Corononavirus-HKU1
FYYLW

SEQ ID NO: 661 - protein, 9 aa, Corononavirus-HKU1
IYCLACRGT

SEQ ID NO: 662 - protein, 13 aa, Corononavirus-HKU1
VWLIYFSMILLGT

SEQ ID NO: 663 - protein, 7 aa, Corononavirus-HKU1
FYFVLFL

SEQ ID NO: 664 - protein, 6 aa, Corononavirus-HKU1
SLLLLF

SEQ ID NO: 665 - protein, 46 aa, Corononavirus-HKU1
QLLSFVCNFVVFVISLLFHLRLTFIKEVCSCISLIVNKLYHPLQII

SEQ ID NO: 666 - protein, 7 aa, Corononavirus-HKU1
SKSKHYE

SEQ ID NO: 667 - protein, 8 aa, Corononavirus-HKU1
IFSSSIYF

SEQ ID NO: 668 - protein, 31 aa, Corononavirus-HKU1
SSCYILKRMEFLFGCNTTFYYYHIAVRLYEP

SEQ ID NO: 669 - protein, 24 aa, Corononavirus-HKU1
YVCLSYQDDYSLAYVAIDYHLDYI

SEQ ID NO: 670 - protein, 6 aa, Corononavirus-HKU1
LFLCFE

SEQ ID NO: 671 - protein, 22 aa, Corononavirus-HKU1
CFSCIFYSVYYYFYCYMDSLFC

SEQ ID NO: 672 - protein, 5 aa, Corononavirus-HKU1
YSAFY

SEQ ID NO: 673 - protein, 7 aa, Corononavirus-HKU1
NWQLVEF

SEQ ID NO: 674 - protein, 4 aa, Corononavirus-HKU1
SRDQ

SEQ ID NO: 675 - protein, 4 aa, Corononavirus-HKU1
SYVY

SEQ ID NO: 676 - protein, 7 aa, Corononavirus-HKU1
YERQDVC

SEQ ID NO: 677 - protein, 37 aa, Corononavirus-HKU1
GLSHINCYCYSWSSLYTGCQTWHWLYSFRFARICYCS

SEQ ID NO: 678 - protein, 7 aa, Corononavirus-HKU1
GASTLYL

SEQ ID NO: 679 - protein, 5 aa, Corononavirus-HKU1
TCLFR

SEQ ID NO: 680 - protein, 6 aa, Corononavirus-HKU1
WFCCFC

SEQ ID NO: 681 - protein, 5 aa, Corononavirus-HKU1
LSFTV

SEQ ID NO: 682 - protein, 14 aa, Corononavirus-HKU1
WYGYCLVKSLNLNY

SEQ ID NO: 683 - protein, 11 aa, Corononavirus-HKU1
DVLYSRSLCWK

SEQ ID NO: 684 - protein, 16 aa, Corononavirus-HKU1
KLLWKSFRNPQENFLG

SEQ ID NO: 685 - protein, 6 aa, Corononavirus-HKU1
AKLPNL

SEQ ID NO: 686 - protein, 6 aa, Corononavirus-HKU1
RQKNPT

SEQ ID NO: 687 - protein, 27 aa, Corononavirus-HKU1
IHCVYSTTRKYYPTLFLVLRDHSISKR

SEQ ID NO: 688 - protein, 16 aa, Corononavirus-HKU1
IFRWSRSSHCFRSTPF

SEQ ID NO: 689 - protein, 6 aa, Corononavirus-HKU1
SKRILV

SEQ ID NO: 690 - protein, 6 aa, Corononavirus-HKU1
TQPAFF

SEQ ID NO: 691 - protein, 26 aa, Corononavirus-HKU1
WSTKAVVTEMVFLLSRYRPICQCILW

SEQ ID NO: 692 - protein, 9 aa, Corononavirus-HKU1
IPRRGLLGC

SEQ ID NO: 693 - protein, 20 aa, Corononavirus-HKU1
HFYSLRCFVKGSYYSRSYPY

SEQ ID NO: 694 - protein, 13 aa, Corononavirus-HKU1
VSAWYDFASRLLC

SEQ ID NO: 695 - protein, 7 aa, Corononavirus-HKU1
RLRKVCF

SEQ ID NO: 696 - protein, 12 aa, Corononavirus-HKU1
STRFTFSITWTQ

SEQ ID NO: 697 - protein, 4 aa, Corononavirus-HKU1
SFIK

SEQ ID NO: 698 - protein, 8 aa, Corononavirus-HKU1
TFRFYSKT

SEQ ID NO: 699 - protein, 7 aa, Corononavirus-HKU1
SCFSQAW

SEQ ID NO: 700 - protein, 5 aa, Corononavirus-HKU1
TSASH

SEQ ID NO: 701 - protein, 8 aa, Corononavirus-HKU1
AKCQGNQA

SEQ ID NO: 702 - protein, 11 aa, Corononavirus-HKU1
NFNKTSPKANS

SEQ ID NO: 703 - protein, 6 aa, Corononavirus-HKU1
CSTVFW

SEQ ID NO: 704 - protein, 8 aa, Corononavirus-HKU1
KRTFSKFW

SEQ ID NO: 705 - protein, 6 aa, Corononavirus-HKU1
NVKAWY

SEQ ID NO: 706 - protein, 20 aa, Corononavirus-HKU1
SSVSYSCRISSYTRCFFLWF

SEQ ID NO: 707 - protein, 4 aa, Corononavirus-HKU1
IRLG

SEQ ID NO: 708 - protein, 5 aa, Corononavirus-HKU1
KRFRG

SEQ ID NO: 709 - protein, 7 aa, Corononavirus-HKU1
TSLFWFY

SEQ ID NO: 710 - protein, 5 aa, Corononavirus-HKU1
YFTRL

SEQ ID NO: 711 - protein, 6 aa, Corononavirus-HKU1
DNYESS

SEQ ID NO: 712 - protein, 7 aa, Corononavirus-HKU1
REFKCLR

SEQ ID NO: 713 - protein, 4 aa, Corononavirus-HKU1
FVEF

SEQ ID NO: 714 - protein, 6 aa, Corononavirus-HKU1
TITRTV

SEQ ID NO: 715 - protein, 10 aa, Corononavirus-HKU1
FKCWYSAHFK

SEQ ID NO: 716 - protein, 5 aa, Corononavirus-HKU1
FTCYS

SEQ ID NO: 717 - protein, 34 aa, Corononavirus-HKU1
SLCRRLCCLMRMNPNSTLGGNPSLLFGIGHSLSE

SEQ ID NO: 718 - protein, 17 aa, Corononavirus-HKU1
ILAVITDRVGCYRLYIN

SEQ ID NO: 719 - protein, 4 aa, Corononavirus-HKU1
KFYI

SEQ ID NO: 720 - protein, 4 aa, Corononavirus-HKU1
TFDC

SEQ ID NO: 721 - protein, 5 aa, Corononavirus-HKU1
SSYKV

SEQ ID NO: 722 - protein, 19 aa, Corononavirus-HKU1
YKRLREELSIVVFNIYISI

SEQ ID NO: 723 - protein, 16 aa, Corononavirus-HKU1
LKLIIAFWRNYKKKKK

SEQ ID NO: 724 - DNA, 29942 bp, Corononavirus-HKU1; identical to SEQ ID NO: 3
  CDS (3)..(29942)

SEQ ID NO: 725 - protein, 34 aa, Corononavirus-HKU1
IRANCVRTVYQLTISCQISLNLNFLNKIPCYPCL

SEQ ID NO: 726 - protein, 19 aa, Corononavirus-HKU1
VWFNHNLVFYFPHFSSLCQ

SEQ ID NO: 727 - protein, 13 aa, Corononavirus-HKU1
RVGCPQRPSHRSQ

SEQ ID NO: 728 - protein, 30 aa, Corononavirus-HKU1
LKPANTVSASSGRQNFVGCFRMQRRSWLVL

SEQ ID NO: 729 - protein, 25 aa, Corononavirus-HKU1
SQMRVGYAPLLVKRWKVLDSFMIIM

SEQ ID NO: 730 - protein, 28 aa, Corononavirus-HKU1
IVAAFLDKNGMCSQILSVIFLFMKIYML

SEQ ID NO: 731 - protein, 4 aa, Corononavirus-HKU1
LKQP

SEQ ID NO: 732 - protein, 6 aa, Corononavirus-HKU1
SPVRQF

SEQ ID NO: 733 - protein, 34 aa, Corononavirus-HKU1
LNHLCIAWVVFLKGMLWACSVHTRLNVMLYIIFL

SEQ ID NO: 734 - protein, 40 aa, Corononavirus-HKU1
LHLLLILVKIFWVGLYLLVLCHLMFTNGFNSVGCILKRVI

SEQ ID NO: 735 - protein, 12 aa, Corononavirus-HKU1
FQILNLMIMILV

SEQ ID NO: 736 - protein, 34 aa, Corononavirus-HKU1
KMLMLRFMLSLKVNIHKKLMLYLDNIVVLNPYFL

SEQ ID NO: 737 - protein, 10 aa, Corononavirus-HKU1
TSMVVTILVN

SEQ ID NO: 738 - protein, 14 aa, Corononavirus-HKU1
QIVFKLMVIILCKI

SEQ ID NO: 739 - protein, 15 aa, Corononavirus-HKU1
DKSSLYGLPIVTLIL

SEQ ID NO: 740 - protein, 4 aa, Corononavirus-HKU1
WLGM

SEQ ID NO: 741 - protein, 12 aa, Corononavirus-HKU1
FVIHDLLCACRL

SEQ ID NO: 742 - protein, 15 aa, Corononavirus-HKU1
LLFVVLNMLHNLQKM

SEQ ID NO: 743 - protein, 13 aa, Corononavirus-HKU1
LYVNLYIYYLLMQ

SEQ ID NO: 744 - protein, 4 aa, Corononavirus-HKU1
SFLV

SEQ ID NO: 745 - protein, 27 aa, Corononavirus-HKU1
LIWMIFLLNLYIMLICVIVVLLCSMVM

SEQ ID NO: 746 - protein, 16 aa, Corononavirus-HKU1
IVLMIIVIFMVGFQVI

SEQ ID NO: 747 - protein, 70 aa, Corononavirus-HKU1
WMVFLVHCVVQFMTLAKLKPNHLVLFLKILCYLLIVLILLTMILLICMVILSHHLVLVYIGRRVLDCGFL

SEQ ID NO: 748 - protein, 15 aa, Corononavirus-HKU1
LNLQSSLMMIWFIQV

SEQ ID NO: 749 - protein, 17 aa, Corononavirus-HKU1
VVNLLLKKLLLLLMHFT

SEQ ID NO: 750 - protein, 36 aa, Corononavirus-HKU1
IMFNVSVVILNKIIFLALIILGVGNCCLIEVIIICF

SEQ ID NO: 751 - protein, 28 aa, Corononavirus-HKU1
KILTCLLSVVLILLASLQFVEMVLYLFY

SEQ ID NO: 752 - protein, 6 aa, Corononavirus-HKU1
FPVVII

SEQ ID NO: 753 - protein, 9 aa, Corononavirus-HKU1
FRVVFSLHL

SEQ ID NO: 754 - protein, 12 aa, Corononavirus-HKU1
CLNFHKKFLICV

SEQ ID NO: 755 - protein, 16 aa, Corononavirus-HKU1
KCVFCLWTEFQLLHFI

SEQ ID NO: 756 - protein, 29 aa, Corononavirus-HKU1
SIMLIGWLLNLSYWVLHLLIKWLIGLIPC

SEQ ID NO: 757 - protein, 14 aa, Corononavirus-HKU1
MLVHLLQAGFFTNY

SEQ ID NO: 758 - protein, 4 aa, Corononavirus-HKU1
MVFL

SEQ ID NO: 759 - protein, 10 aa, Corononavirus-HKU1
YLKPTLILLL

SEQ ID NO: 760 - protein, 7 aa, Corononavirus-HKU1
YLIMLKF

SEQ ID NO: 761 - protein, 11 aa, Corononavirus-HKU1
LINFTLFLSYY

SEQ ID NO: 762 - protein, 7 aa, Corononavirus-HKU1
SVLQLMF

SEQ ID NO: 763 - protein, 11 aa, Corononavirus-HKU1
KICLFLKLLMV

SEQ ID NO: 764 - protein, 10 aa, Corononavirus-HKU1
AISFITLVQG

SEQ ID NO: 765 - protein, 25 aa, Corononavirus-HKU1
FLVLFYHVMHRNNKFIFLKALQNLL

SEQ ID NO: 766 - protein, 23 aa, Corononavirus-HKU1
KMMLLRMSNLLYHLMSIVNHLNL

SEQ ID NO: 767 - protein, 5 aa, Corononavirus-HKU1
KKFVL

SEQ ID NO: 768 - protein, 16 aa, Corononavirus-HKU1
IICTWVSVVINFSLLS

SEQ ID NO: 769 - protein, 7 aa, Corononavirus-HKU1
MIKIFVF

SEQ ID NO: 770 - protein, 26 aa, Corononavirus-HKU1
IRLGVFHVQVEKLILTRNLLLWRFRL

SEQ ID NO: 771 - protein, 7 aa, Corononavirus-HKU1
QLRLCLI

SEQ ID NO: 772 - protein, 7 aa, Corononavirus-HKU1
ILLLMIF

SEQ ID NO: 773 - protein, 8 aa, Corononavirus-HKU1
VKFVQNLK

SEQ ID NO: 774 - protein, 5 aa, Corononavirus-HKU1
KRVLL

SEQ ID NO: 775 - protein, 10 aa, Corononavirus-HKU1
MILLLLFVML

SEQ ID NO: 776 - protein, 16 aa, Corononavirus-HKU1
TLVKSIQWLVIKFVHF

SEQ ID NO: 777 - protein, 214 aa, Corononavirus-HKU1
INLMRMLFIYLMRLVMKQWPLVCIVLLLLRMLKTLSVVKLSKILLMVSLKTLLMTMKMLLLVTMTMKMLLLVTMTMKMLLLVTMTMKMLLLVTMTMKMLLLVTMTMKMLLLVTMTMKMLLLVTMTMKMLLLVTMTMKMLLLVTMTMKMLLLVTMTMKMLLLVTMTMKMLLLVTMTMKMLLLVTMTMKMLLLVTITMKRLLLVTMMTKLLLLVMM

SEQ ID NO: 778 - protein, 15 aa, Corononavirus-HKU1
MILKVFMTLILIKLF

SEQ ID NO: 779 - protein, 46 aa, Corononavirus-HKU1
FLMMSIMMLCLLVMVLVLKQKHILKLMVYGHLLLHILIVGCVLCYL

SEQ ID NO: 780 - protein, 10 aa, Corononavirus-HKU1
CRNYLLSLRI

SEQ ID NO: 781 - protein, 21 aa, Corononavirus-HKU1
LLKICGYLIRWVIIKVLLIIY

SEQ ID NO: 782 - protein, 14 aa, Corononavirus-HKU1
PLFLKLLFCLKVVL

SEQ ID NO: 783 - protein, 7 aa, Corononavirus-HKU1
LILLIGF

SEQ ID NO: 784 - protein, 13 aa, Corononavirus-HKU1
TSLILMRMLIGVV

SEQ ID NO: 785 - protein, 7 aa, Corononavirus-HKU1
NVVFLLI

SEQ ID NO: 786 - protein, 22 aa, Corononavirus-HKU1
MVWMLCFFMEILCLMFVSVDII

SEQ ID NO: 787 - protein, 34 aa, Corononavirus-HKU1
QRTYLVHYIFHYLMTIFVLFAPLKKFLLLHVLWM

SEQ ID NO: 788 - protein, 5 aa, Corononavirus-HKU1
TFVIL

SEQ ID NO: 789 - protein, 4 aa, Corononavirus-HKU1
VMNK

SEQ ID NO: 790 - protein, 15 aa, Corononavirus-HKU1
MVSLLLNLVVINLIL

SEQ ID NO: 791 - protein, 20 aa, Corononavirus-HKU1
VMECHLVCLLLSYLNCMVCV

SEQ ID NO: 792 - protein, 11 aa, Corononavirus-HKU1
HLMYVLLKVIL

SEQ ID NO: 793 - protein, 28 aa, Corononavirus-HKU1
MLLDLLKLMLLLILLMGICSMVVELQKL

SEQ ID NO: 794 - protein, 21 aa, Corononavirus-HKU1
LQVKNFLKKLLLWLNLKVFAK

SEQ ID NO: 795 - protein, 18 aa, Corononavirus-HKU1
EIVMFLPVVNYVKQFLIL

SEQ ID NO: 796 - protein, 14 aa, Corononavirus-HKU1
ALMLDKMEDNLMFC

SEQ ID NO: 797 - protein, 30 aa, Corononavirus-HKU1
HVLISILIIMIVVCLLSYRLVYLVFLLMCH

SEQ ID NO: 798 - protein, 37 aa, Corononavirus-HKU1
VLLINKLSLLVIIKKILILFKNVKLLQLLVLKHWLLD

SEQ ID NO: 799 - protein, 14 aa, Corononavirus-HKU1
AVLLNLRQMHTNFF

SEQ ID NO: 800 - protein, 24 aa, Corononavirus-HKU1
VVMIVLFQILLLYKKFYCFVMIYN

SEQ ID NO: 801 - protein, 11 aa, Corononavirus-HKU1
IMTFVIICCLR

SEQ ID NO: 802 - protein, 59 aa, Corononavirus-HKU1
LVFLKIGVLSINLMLLTVLKLLSILSVLILFIYVVRVKTLVMYVMVLFIKQLLIKFVFY

SEQ ID NO: 803 - protein, 5 aa, Corononavirus-HKU1
MFCLL

SEQ ID NO: 804 - protein, 11 aa, Corononavirus-HKU1
MVLILNLFLLL

SEQ ID NO: 805 - protein, 20 aa, Corononavirus-HKU1
VKFLVKYLVMFSVMALMLLS

SEQ ID NO: 806 - protein, 18 aa, Corononavirus-HKU1
SVVIFMPIKFYISMKICL

SEQ ID NO: 807 - protein, 23 aa, Corononavirus-HKU1
LIFLLYKVHLGLISNNCLLIIIF

SEQ ID NO: 808 - protein, 6 aa, Corononavirus-HKU1
QYVNGL

SEQ ID NO: 809 - protein, 17 aa, Corononavirus-HKU1
LLTVHFFLLNSLIIIVM

SEQ ID NO: 810 - protein, 31 aa, Corononavirus-HKU1
LVLCCSILILNLINGSGRKHGMNFVLADHIG

SEQ ID NO: 811 - protein, 4 aa, Corononavirus-HKU1
LLLF

SEQ ID NO: 812 - protein, 20 aa, Corononavirus-HKU1
LKVILNLMNHQMLLILFVLF

SEQ ID NO: 813 - protein, 11 aa, Corononavirus-HKU1
NKLIYQVQFVN

SEQ ID NO: 814 - protein, 24 aa, Corononavirus-HKU1
NLFVIVVLNKKVVLVLMLLCILVH

SEQ ID NO: 815 - protein, 24 aa, Corononavirus-HKU1
QRLIFLMVIRLAVIVQVELSIVLN

SEQ ID NO: 816 - protein, 4 aa, Corononavirus-HKU1
MYHF

SEQ ID NO: 817 - protein, 6 aa, Corononavirus-HKU1
FVLILL

SEQ ID NO: 818 - protein, 16 aa, Corononavirus-HKU1
VRIYLMMLLQLTCLWV

SEQ ID NO: 819 - protein, 5 aa, Corononavirus-HKU1
AIIHI

SEQ ID NO: 820 - protein, 23 aa, Corononavirus-HKU1
NVVHLTNIMMLVVLKNIQVLVVV

SEQ ID NO: 821 - protein, 8 aa, Corononavirus-HKU1
LTACILKI

SEQ ID NO: 822 - protein, 7 aa, Corononavirus-HKU1
PRLLHLC

SEQ ID NO: 823 - protein, 32 aa, Corononavirus-HKU1
LIIFWMMLKWLLITLIFHNIIVIMVSIIQNLL

SEQ ID NO: 824 - protein, 18 aa, Corononavirus-HKU1
RLSLNHLLKLTVFILTLS

SEQ ID NO: 825 - protein, 8 aa, Corononavirus-HKU1
LDMIFVLN

SEQ ID NO: 826 - protein, 8 aa, Corononavirus-HKU1
ICRLLSTK

SEQ ID NO: 827 - protein, 4 aa, Corononavirus-HKU1
QSGL

SEQ ID NO: 828 - protein, 13 aa, Corononavirus-HKU1
LLVMLFWHLMIYM

SEQ ID NO: 829 - protein, 23 aa, Corononavirus-HKU1
NVILKDVKLLVSLLFGFVMMKHH

SEQ ID NO: 830 - protein, 48 aa, Corononavirus-HKU1
ILLLILINLVLNLKIDIVFCLLILYLRSHKVMWLLLLWNRRLVLKRLS

SEQ ID NO: 831 - protein, 8 aa, Corononavirus-HKU1
RVLERLLK

SEQ ID NO: 832 - protein, 20 aa, Corononavirus-HKU1
KMLLLLMMKIVLLRLLKVYL

SEQ ID NO: 833 - protein, 7 aa, Corononavirus-HKU1
LMFGICI

SEQ ID NO: 834 - protein, 15 aa, Corononavirus-HKU1
QVVIMLFGLLMNCHA

SEQ ID NO: 835 - protein, 20 aa, Corononavirus-HKU1
LNHQQLGNIYDMVLNLLLYL

SEQ ID NO: 836 - protein, 4 aa, Corononavirus-HKU1
ICYV

SEQ ID NO: 837 - protein, 7 aa, Corononavirus-HKU1
EMIIKLF

SEQ ID NO: 838 - protein, 9 aa, Corononavirus-HKU1
FLKFLKQEL

SEQ ID NO: 839 - protein, 5 aa, Corononavirus-HKU1
NFMVF

SEQ ID NO: 840 - protein, 24 aa, Corononavirus-HKU1
SGCLFMFLVYYILQMIKPFFILQK

SEQ ID NO: 841 - protein, 25 aa, Corononavirus-HKU1
LLSLLLICFVWLLKMLFRHLDGVYL

SEQ ID NO: 842 - protein, 5 aa, Corononavirus-HKU1
KVFLL

SEQ ID NO: 843 - protein, 12 aa, Corononavirus-HKU1
PLCFCFGLIFCI

SEQ ID NO: 844 - protein, 25 aa, Corononavirus-HKU1
MLFLVTFIFLILVFFLFLWEELLCG

SEQ ID NO: 845 - protein, 15 aa, Corononavirus-HKU1
RLLLVWLQFVIFILS

SEQ ID NO: 846 - protein, 28 aa, Corononavirus-HKU1
VLQVIFVMVVLYVNCVILVLICWIHMQL

SEQ ID NO: 847 - protein, 6 aa, Corononavirus-HKU1
ILFSMK

SEQ ID NO: 848 - protein, 10 aa, Corononavirus-HKU1
IDVFYLIMLV

SEQ ID NO: 849 - protein, 36 aa, Corononavirus-HKU1
LLNSLLVIHYTQYGFIHYFVLLVYNYLLHGCLICLC

SEQ ID NO: 850 - protein, 5 aa, Corononavirus-HKU1
KLCIG

SEQ ID NO: 851 - protein, 6 aa, Corononavirus-HKU1
LDLLYL

SEQ ID NO: 852 - protein, 13 aa, Corononavirus-HKU1
LICYLLLSCCGFI

SEQ ID NO: 853 - protein, 7 aa, Corononavirus-HKU1
LLLLCIK

SEQ ID NO: 854 - protein, 36 aa, Corononavirus-HKU1
LVLLGILSMVVIKLVVYFVINEIVVFVLSVVLLLVV

SEQ ID NO: 855 - protein, 34 aa, Corononavirus-HKU1
FVIMILLLMVVLVFVLNINGIVLIAILLNQVTLL

SEQ ID NO: 856 - protein, 9 aa, Corononavirus-HKU1
NFLKSLNDL

SEQ ID NO: 857 - protein, 8 aa, Corononavirus-HKU1
IQLMLHIM

SEQ ID NO: 858 - protein, 9 aa, Corononavirus-HKU1
LLILSKLVV

SEQ ID NO: 859 - protein, 21 aa, Corononavirus-HKU1
CVCSMIEMDSVFTMMLMLVYL

SEQ ID NO: 860 - protein, 17 aa, Corononavirus-HKU1
ILIICYILKLKLFLICM

SEQ ID NO: 861 - protein, 9 aa, Corononavirus-HKU1
RVMLIELIF

SEQ ID NO: 862 - protein, 16 aa, Corononavirus-HKU1
MLLCFMHNHCIGLYYL

SEQ ID NO: 863 - protein, 9 aa, Corononavirus-HKU1
LLQLVMVSL

SEQ ID NO: 864 - protein, 39 aa, Corononavirus-HKU1
PRLCLMFMLILLCLILMLIERVLIILLTLLMLLLERVCN

SEQ ID NO: 865 - protein, 25 aa, Corononavirus-HKU1
ILLWDVYVNVVPLIQMLKQDLLLNL

SEQ ID NO: 866 - protein, 18 aa, Corononavirus-HKU1
LLVWNLLMKIITIWYLHI

SEQ ID NO: 867 - protein, 5 aa, Corononavirus-HKU1
RVIIL

SEQ ID NO: 868 - protein, 40 aa, Corononavirus-HKU1
VFLYRMVLSMYRVMLLRQLIFLVYGLLMLLINLLLIYSIN

SEQ ID NO: 869 - protein, 8 aa, Corononavirus-HKU1
KKHVLKLA

SEQ ID NO: 870 - protein, 23 aa, Corononavirus-HKU1
LLISKRQVSLFLQHPFHLKEVLY

SEQ ID NO: 871 - protein, 11 aa, Corononavirus-HKU1
VICYIYYFLLV

SEQ ID NO: 872 - protein, 74 aa, Corononavirus-HKU1
SVLYYCGLYCLHIVFISLIFICLLMLVLKLLIMVLLEIFQLMIYVLLINFSNLINGMSPLLGLFTIIILWIALL

SEQ ID NO: 873 - protein, 19 aa, Corononavirus-HKU1
WQLWMKISVLLCLMFLLKF

SEQ ID NO: 874 - protein, 9 aa, Corononavirus-HKU1
DMAFMFYIF

SEQ ID NO: 875 - protein, 53 aa, Corononavirus-HKU1
LMHLLVIVFSAIHHIFRFLIMIFMLVVVFYHLCVLCLKEVMVHHILIVIQMVL

SEQ ID NO: 876 - protein, 23 aa, Corononavirus-HKU1
RMLLCIHLWFHIHVIALLILMVL

SEQ ID NO: 877 - protein, 13 aa, Corononavirus-HKU1
DFLMLLVKVLYVL

SEQ ID NO: 878 - protein, 4 aa, Corononavirus-HKU1
ERAL

SEQ ID NO: 879 - protein, 24 aa, Corononavirus-HKU1
LIVEWVHVNTPKRVYVLILIVPGF

SEQ ID NO: 880 - protein, 27 aa, Corononavirus-HKU1
IMIIIEVCLELFVVEIFLICFINFLVV

SEQ ID NO: 881 - protein, 16 aa, Corononavirus-HKU1
ISFLLLLVLFLELYWL

SEQ ID NO: 882 - protein, 8 aa, Corononavirus-HKU1
LLSWFFII

SEQ ID NO: 883 - protein, 12 aa, Corononavirus-HKU1
NLSVLLEIILVL

SEQ ID NO: 884 - protein, 31 aa, Corononavirus-HKU1
MLLFGVLIFLCFLFFKFILFVHVFMLVFIFM

SEQ ID NO: 885 - protein, 9 aa, Corononavirus-HKU1
HCIFLLKLV

SEQ ID NO: 886 - protein, 12 aa, Corononavirus-HKU1
LCICNGLLCMVL

SEQ ID NO: 887 - protein, 9 aa, Corononavirus-HKU1
CLFGFVSHM

SEQ ID NO: 888 - protein, 36 aa, Corononavirus-HKU1
LWLLQTMFYGYFHIVGKLVLMYVVIVHLKKHLLLLL

SEQ ID NO: 889 - protein, 8 aa, Corononavirus-HKU1
LLKILIVD

SEQ ID NO: 890 - protein, 12 aa, Corononavirus-HKU1
RILFLMLPTIDI

SEQ ID NO: 891 - protein, 25 aa, Corononavirus-HKU1
VCIISIVTIVVKWILLPIEKRRVLS

SEQ ID NO: 892 - protein, 33 aa, Corononavirus-HKU1
LKLWKHLITIMVMMSYTNLLQHLFLHLFCNQVL

SEQ ID NO: 893 - protein, 20 aa, Corononavirus-HKU1
RWYLLRQKLNLVLLVLLMVV

SEQ ID NO: 894 - protein, 4 aa, Corononavirus-HKU1
MVYG

SEQ ID NO: 895 - protein, 16 aa, Corononavirus-HKU1
MTKFIVLVMLYVHPLI

SEQ ID NO: 896 - protein, 13 aa, Corononavirus-HKU1
TNLIILPYCVELL

SEQ ID NO: 897 - protein, 4 aa, Corononavirus-HKU1
VILL

SEQ ID NO: 898 - protein, 4 aa, Corononavirus-HKU1
CLVG

SEQ ID NO: 899 - protein, 13 aa, Corononavirus-HKU1
QLCLTRCRAVNLF

SEQ ID NO: 900 - protein, 25 aa, Corononavirus-HKU1
QSLYKILTLQNILLVMLNLVKLLLF

SEQ ID NO: 901 - protein, 36 aa, Corononavirus-HKU1
LRIMADHKGHFMLLCVVVILLKVLFCVGHVDLLVMY

SEQ ID NO: 902 - protein, 12 aa, Corononavirus-HKU1
QVIVLSLYICIN

SEQ ID NO: 903 - protein, 76 aa, Corononavirus-HKU1
SSVLVVTLALILLVIFMVHIEMLKLYSCQLRTTSRLLMLLLGSMQLYLIIVLGLYKMMFVLLKILMFGLWQMVLAK

SEQ ID NO: 904 - protein, 5 aa, Corononavirus-HKU1
KQILS

SEQ ID NO: 905 - protein, 5 aa, Corononavirus-HKU1
MLWLQ

SEQ ID NO: 906 - protein, 24 aa, Corononavirus-HKU1
QVFLLKLYWLLLSVYIWDFKVVKY

SEQ ID NO: 907 - protein, 38 aa, Corononavirus-HKU1
EVVLLKMNWHLLTFINNWLVLNCNLKQKDLLKKQFIGF

SEQ ID NO: 908 - protein, 8 aa, Corononavirus-HKU1
YLHFCLVV

SEQ ID NO: 909 - protein, 16 aa, Corononavirus-HKU1
FLHLLNGLYLCILIHI

SEQ ID NO: 910 - protein, 13 aa, Corononavirus-HKU1
LVLHYVYFVLLVL

SEQ ID NO: 911 - protein, 7 aa, Corononavirus-HKU1
LNISIFI

SEQ ID NO: 912 - protein, 9 aa, Corononavirus-HKU1
FLYSVPCFM

SEQ ID NO: 913 - protein, 21 aa, Corononavirus-HKU1
LFIRKVLEVLLMSGSHILFLL

SEQ ID NO: 914 - protein, 20 aa, Corononavirus-HKU1
ILLMFMKYFMVVFYVFLLFL

SEQ ID NO: 915 - protein, 11 aa, Corononavirus-HKU1
LCIVLIMTFFL

SEQ ID NO: 916 - protein, 6 aa, Corononavirus-HKU1
CFWLVE

SEQ ID NO: 917 - protein, 9 aa, Corononavirus-HKU1
FLCGILGRI

SEQ ID NO: 918 - protein, 11 aa, Corononavirus-HKU1
KRMFCYLLQPF

SEQ ID NO: 919 - protein, 10 aa, Corononavirus-HKU1
VLIHGPLFCH

SEQ ID NO: 920 - protein, 22 aa, Corononavirus-HKU1
QKLLLIGCLLIYFILQMYLILN

SEQ ID NO: 921 - protein, 4 aa, Corononavirus-HKU1
VTYL

SEQ ID NO: 922 - protein, 13 aa, Corononavirus-HKU1
GIFYLVIGDFSLF

SEQ ID NO: 923 - protein, 22 aa, Corononavirus-HKU1
TVFLECLWVFIIIKFLFKNCVI

SEQ ID NO: 924 - protein, 16 aa, Corononavirus-HKU1
MLMAYVHLVIVLRLFC

SEQ ID NO: 925 - protein, 4 aa, Corononavirus-HKU1
NCLE

SEQ ID NO: 926 - protein, 14 aa, Corononavirus-HKU1
VACQLLKSPKFNQN

SEQ ID NO: 927 - protein, 7 aa, Corononavirus-HKU1
NVLMLFC

SEQ ID NO: 928 - protein, 30 aa, Corononavirus-HKU1
IVYSICMLLLILSCGSIVVFYIMKYYLLQI

SEQ ID NO: 929 - protein, 8 aa, Corononavirus-HKU1
LLISLLNY

SEQ ID NO: 930 - protein, 17 aa, Corononavirus-HKU1
LFYSPILLQLILSVLQV

SEQ ID NO: 931 - protein, 21 aa, Corononavirus-HKU1
MKLAMIMFKIVPFCRLCKVSL

SEQ ID NO: 932 - protein, 28 aa, Corononavirus-HKU1
IWLVLLNMKSQRKIWLMLKIVVLLINNR

SEQ ID NO: 933 - protein, 5 aa, Corononavirus-HKU1
KKHVI

SEQ ID NO: 934 - protein, 10 aa, Corononavirus-HKU1
LSLCMNVIKL

SEQ ID NO: 935 - protein, 9 aa, Corononavirus-HKU1
LANLNVWQT

SEQ ID NO: 936 - protein, 37 aa, Corononavirus-HKU1
HLLTCIKRLGLMIRRVKLFPLCRQCFLAWFVNWIIRL

SEQ ID NO: 937 - protein, 13 aa, Corononavirus-HKU1
ILFWIMLLKVVYL

SEQ ID NO: 938 - protein, 10 aa, Corononavirus-HKU1
VLFQHWLLIL

SEQ ID NO: 939 - protein, 37 aa, Corononavirus-HKU1
YQINKFLIKLLIMFMLHMLVVYGIYRLFKMLMVLINS

SEQ ID NO: 940 - protein, 30 aa, Corononavirus-HKU1
LILVLILIGLLLSLRTGIMKLLMLLCRIMS

SEQ ID NO: 941 - protein, 4 aa, Corononavirus-HKU1
CLIN

SEQ ID NO: 942 - protein, 10 aa, Corononavirus-HKU1
KYKLLIVVLI

SEQ ID NO: 943 - protein, 17 aa, Corononavirus-HKU1
IVIFLLNVIIIMVVVVE

SEQ ID NO: 944 - protein, 15 aa, Corononavirus-HKU1
FMLFLVMLMVLSILR

SEQ ID NO: 945 - protein, 8 aa, Corononavirus-HKU1
KMMEIVLF

SEQ ID NO: 946 - protein, 29 aa, Corononavirus-HKU1
SLILLVNFLYKMLRDLKLSIFILLKDVTL

SEQ ID NO: 947 - protein, 36 aa, Corononavirus-HKU1
LEGGLLVLYLQQLDCRLVLLLSMQLILLYFHYVHFL

SEQ ID NO: 948 - protein, 6 aa, Corononavirus-HKU1
ILRKLI

SEQ ID NO: 949 - protein, 9 aa, Corononavirus-HKU1
IIYNKVVYL

SEQ ID NO: 950 - protein, 42 aa, Corononavirus-HKU1
LIVLKCSVIMLVLVWPLLLNLRLLLTKILMVVPQFVFIAVHV

SEQ ID NO: 951 - protein, 4 aa, Corononavirus-HKU1
SIQM

SEQ ID NO: 952 - protein, 16 aa, Corononavirus-HKU1
MVYVNYVVNLYKSLWV

SEQ ID NO: 953 - protein, 7 aa, Corononavirus-HKU1
KILFFMC

SEQ ID NO: 954 - protein, 18 aa, Corononavirus-HKU1
HMMFVKSVVFGEMAVVPV

SEQ ID NO: 955 - protein, 10 aa, Corononavirus-HKU1
VQVSLFNLKI

SEQ ID NO: 956 - protein, 5 aa, Corononavirus-HKU1
TGSGY

SEQ ID NO: 957 - protein, 9 aa, Corononavirus-HKU1
CECPASTLC

SEQ ID NO: 958 - protein, 4 aa, Corononavirus-HKU1
WFIY

SEQ ID NO: 959 - protein, 6 aa, Corononavirus-HKU1
CSIKGI

SEQ ID NO: 960 - protein, 7 aa, Corononavirus-HKU1
SWYRFIL

SEQ ID NO: 961 - protein, 10 aa, Corononavirus-HKU1
SELLPFSAYR

SEQ ID NO: 962 - protein, 7 aa, Corononavirus-HKU1
VLCCQKN

SEQ ID NO: 963 - protein, 4 aa, Corononavirus-HKU1
FRSL

SEQ ID NO: 964 - protein, 5 aa, Corononavirus-HKU1
RENLL

SEQ ID NO: 965 - protein, 6 aa, Corononavirus-HKU1
KLWCCG

SEQ ID NO: 966 - protein, 4 aa, Corononavirus-HKU1
FLYI

SEQ ID NO: 967 - protein, 7 aa, Corononavirus-HKU1
SRATYSS

SEQ ID NO: 968 - protein, 17 aa, Corononavirus-HKU1
ESFKVYYVRSLLCIASF

SEQ ID NO: 969 - protein, 5 aa, Corononavirus-HKU1
LFNIV

SEQ ID NO: 970 - protein, 5 aa, Corononavirus-HKU1
RILLF

SEQ ID NO: 971 - protein, 4 aa, Corononavirus-HKU1
ERLV

SEQ ID NO: 972 - protein, 6 aa, Corononavirus-HKU1
KIRPYF

SEQ ID NO: 973 - protein, 9 aa, Corononavirus-HKU1
YCHFCRHLS

SEQ ID NO: 974 - protein, 10 aa, Corononavirus-HKU1
SRFSWCFNFR

SEQ ID NO: 975 - protein, 8 aa, Corononavirus-HKU1
PRFVWSMV

SEQ ID NO: 976 - protein, 32 aa, Corononavirus-HKU1
FYTNSPRVWCGSCRFLLFLYDAYVDYVSCIRL

SEQ ID NO: 977 - protein, 7 aa, Corononavirus-HKU1
TIRSCTV

SEQ ID NO: 978 - protein, 6 aa, Corononavirus-HKU1
LQVRVV

SEQ ID NO: 979 - protein, 8 aa, Corononavirus-HKU1
VLGYEVSS

SEQ ID NO: 980 - protein, 4 aa, Corononavirus-HKU1
YCGL

SEQ ID NO: 981 - protein, 6 aa, Corononavirus-HKU1
VYYSLC

SEQ ID NO: 982 - protein, 4 aa, Corononavirus-HKU1
YGFT

SEQ ID NO: 983 - protein, 7 aa, Corononavirus-HKU1
YLFWSPC

SEQ ID NO: 984 - protein, 28 aa, Corononavirus-HKU1
TNFCRWCTVCCFYWLPLQRVRCSYELRC

SEQ ID NO: 985 - protein, 8 aa, Corononavirus-HKU1
HTPLSFVS

SEQ ID NO: 986 - protein, 16 aa, Corononavirus-HKU1
RFTSLCSRSCYARCIC

SEQ ID NO: 987 - protein, 6 aa, Corononavirus-HKU1
FTNLLF

SEQ ID NO: 988 - protein, 16 aa, Corononavirus-HKU1
CSCHYKWYKISNCKTR

SEQ ID NO: 989 - protein, 7 aa, Corononavirus-HKU1
PRLLRVC

SEQ ID NO: 990 - protein, 10 aa, Corononavirus-HKU1
FETFFLYSRW

SEQ ID NO: 991 - protein, 4 aa, Corononavirus-HKU1
CCNY

SEQ ID NO: 992 - protein, 5 aa, Corononavirus-HKU1
FTYYG

SEQ ID NO: 993 - protein, 10 aa, Corononavirus-HKU1
AVIVCIRSCL

SEQ ID NO: 994 - protein, 11 aa, Corononavirus-HKU1
WWLYTSITSYC

SEQ ID NO: 995 - protein, 6 aa, Corononavirus-HKU1
KCWLSI

SEQ ID NO: 996 - protein, 5 aa, Corononavirus-HKU1
SQTLL

SEQ ID NO: 997 - protein, 4 aa, Corononavirus-HKU1
GIII

SEQ ID NO: 998 - protein, 5 aa, Corononavirus-HKU1
NLCIY

SEQ ID NO: 999 - protein, 16 aa, Corononavirus-HKU1
CSAHLNSNEFKICYQC

SEQ ID NO: 1000 - protein, 10 aa, Corononavirus-HKU1
SSHCSRCFYS

SEQ ID NO: 1001 - protein, 28 aa, Corononavirus-HKU1
YYDRPNVPSKMFEEYSSYPRCSCCYRNH

SEQ ID NO: 1002 - protein, 16 aa, Corononavirus-HKU1
ILWWLGRYVTSSYKGC

SEQ ID NO: 1003 - protein, 10 aa, Corononavirus-HKU1
QPCSYGLGLS

SEQ ID NO: 1004 - protein, 10 aa, Corononavirus-HKU1
SCYAKYFAYC

SEQ ID NO: 1005 - protein, 7 aa, Corononavirus-HKU1
FSFGPQT

SEQ ID NO: 1006 - protein, 6 aa, Corononavirus-HKU1
ILLFTW

SEQ ID NO: 1007 - protein, 6 aa, Corononavirus-HKU1
ILSPCE

SEQ ID NO: 1008 - protein, 6 aa, Corononavirus-HKU1
MCSSFE

SEQ ID NO: 1009 - protein, 10 aa, Corononavirus-HKU1
NSYVWRLLLC

SEQ ID NO: 1010 - protein, 4 aa, Corononavirus-HKU1
AWWY

SEQ ID NO: 1011 - protein, 6 aa, Corononavirus-HKU1
CNYCFC

SEQ ID NO: 1012 - protein, 7 aa, Corononavirus-HKU1
YMSGCYC

SEQ ID NO: 1013 - protein, 7 aa, Corononavirus-HKU1
CLFSYGL

SEQ ID NO: 1014 - protein, 13 aa, Corononavirus-HKU1
RFKYTQFTKTLIL

SEQ ID NO: 1015 - protein, 7 aa, Corononavirus-HKU1
CLSYRLC

SEQ ID NO: 1016 - protein, 4 aa, Corononavirus-HKU1
LYIC

SEQ ID NO: 1017 - protein, 5 aa, Corononavirus-HKU1
YDDFE

SEQ ID NO: 1018 - protein, 5 aa, Corononavirus-HKU1
WCCLL

SEQ ID NO: 1019 - protein, 4 aa, Corononavirus-HKU1
GLYS

SEQ ID NO: 1020 - protein, 12 aa, Corononavirus-HKU1
YKCFSTSFVLSE

SEQ ID NO: 1021 - protein, 4 aa, Corononavirus-HKU1
CLYV

SEQ ID NO: 1022 - protein, 9 aa, Corononavirus-HKU1
ILFPTYYVS

SEQ ID NO: 1023 - protein, 10 aa, Corononavirus-HKU1
LCLFTISRSF

SEQ ID NO: 1024 - protein, 8 aa, Corononavirus-HKU1
NFRSWLFC

SEQ ID NO: 1025 - protein, 4 aa, Corononavirus-HKU1
FIED

SEQ ID NO: 1026 - protein, 21 aa, Corononavirus-HKU1
QCSFDRALCKSSYRCLPFSTS

SEQ ID NO: 1027 - protein, 17 aa, Corononavirus-HKU1
RIPKSLSCIFRIYKKTV

SEQ ID NO: 1028 - protein, 7 aa, Corononavirus-HKU1
SWYSDLR

SEQ ID NO: 1029 - protein, 6 aa, Corononavirus-HKU1
CYFKYL

SEQ ID NO: 1030 - protein, 5 aa, Corononavirus-HKU1
WFKVY

SEQ ID NO: 1031 - protein, 36 aa, Corononavirus-HKU1
RIILQEYVFKKCRDAECRCMRCLFITNFFALWQLYT

SEQ ID NO: 1032 - protein, 5 aa, Corononavirus-HKU1
AFVML

SEQ ID NO: 1033 - protein, 5 aa, Corononavirus-HKU1
PCYGN

SEQ ID NO: 1034 - protein, 10 aa, Corononavirus-HKU1
ICFECLTLRL

SEQ ID NO: 1035 - protein, 13 aa, Corononavirus-HKU1
CHQIIFGRYVLLL

SEQ ID NO: 1036 - protein, 5 aa, Corononavirus-HKU1
TPLFI

SEQ ID NO: 1037 - protein, 11 aa, Corononavirus-HKU1
VSYEWYGLWFV

SEQ ID NO: 1038 - protein, 10 aa, Corononavirus-HKU1
TILHGFTLYR

SEQ ID NO: 1039 - protein, 4 aa, Corononavirus-HKU1
MDRS

SEQ ID NO: 1040 - protein, 5 aa, Corononavirus-HKU1
LCSGK

SEQ ID NO: 1041 - protein, 13 aa, Corononavirus-HKU1
TFKVICCRNSKGN

SEQ ID NO: 1042 - protein, 12 aa, Corononavirus-HKU1
TKLCFCYHSRDC

SEQ ID NO: 1043 - protein, 9 aa, Corononavirus-HKU1
RSYFVLGDR

SEQ ID NO: 1044 - protein, 10 aa, Corononavirus-HKU1
KLCFHRLPFY

SEQ ID NO: 1045 - protein, 4 aa, Corononavirus-HKU1
DSFR

SEQ ID NO: 1046 - protein, 10 aa, Corononavirus-HKU1
RCVLPRYNYL

SEQ ID NO: 1047 - protein, 4 aa, Corononavirus-HKU1
TFYR

SEQ ID NO: 1048 - protein, 10 aa, Corononavirus-HKU1
CFCFNITFCS

SEQ ID NO: 1049 - protein, 13 aa, Corononavirus-HKU1
FKCTYTCPTRELC

SEQ ID NO: 1050 - protein, 4 aa, Corononavirus-HKU1
YKIF

SEQ ID NO: 1051 - protein, 7 aa, Corononavirus-HKU1
CSIGVSK

SEQ ID NO: 1052 - protein, 41 aa, Corononavirus-HKU1
LSAHWNETLLHCSRSPWYGKVSSCYRSSCLLLHSTCSLYCC

SEQ ID NO: 1053 - protein, 8 aa, Corononavirus-HKU1
SCCCRCIV

SEQ ID NO: 1054 - protein, 4 aa, Corononavirus-HKU1
VFKY

SEQ ID NO: 1055 - protein, 8 aa, Corononavirus-HKU1
RLYTYYSC

SEQ ID NO: 1056 - protein, 6 aa, Corononavirus-HKU1
SSCRLL

SEQ ID NO: 1057 - protein, 19 aa, Corononavirus-HKU1
VCFYHNKCITRVGYRYCCC

SEQ ID NO: 1058 - protein, 8 aa, Corononavirus-HKU1
IVCYKCSY

SEQ ID NO: 1059 - protein, 25 aa, Corononavirus-HKU1
TLCIYWRSCSITCTTCAVEQGFFRT

SEQ ID NO: 1060 - protein, 6 aa, Corononavirus-HKU1
ALQFYY

SEQ ID NO: 1061 - protein, 7 aa, Corononavirus-HKU1
NNVLFRS

SEQ ID NO: 1062 - protein, 7 aa, Corononavirus-HKU1
YLFGKLL

SEQ ID NO: 1063 - protein, 11 aa, Corononavirus-HKU1
RNCRNCFSIGL

SEQ ID NO: 1064 - protein, 4 aa, Corononavirus-HKU1
FIMF

SEQ ID NO: 1065 - protein, 5 aa, Corononavirus-HKU1
GTDNT

SEQ ID NO: 1066 - protein, 13 aa, Corononavirus-HKU1
EFKCCKYSTDISN

SEQ ID NO: 1067 - protein, 4 aa, Corononavirus-HKU1
IFKS

SEQ ID NO: 1068 - protein, 4 aa, Corononavirus-HKU1
SSLE

SEQ ID NO: 1069 - protein, 4 aa, Corononavirus-HKU1
CCFY

SEQ ID NO: 1070 - protein, 5 aa, Corononavirus-HKU1
SELCC

SEQ ID NO: 1071 - protein, 18 aa, Corononavirus-HKU1
ACFRCSNTNCRFCSRFGI

SEQ ID NO: 1072 - protein, 14 aa, Corononavirus-HKU1
LCYIFTNSRNSPFC

SEQ ID NO: 1073 - protein, 4 aa, Corononavirus-HKU1
CCHN

SEQ ID NO: 1074 - protein, 10 aa, Corononavirus-HKU1
SQEGHFLCYE

SEQ ID NO: 1075 - protein, 4 aa, Corononavirus-HKU1
YAII

SEQ ID NO: 1076 - protein, 7 aa, Corononavirus-HKU1
FYYSTFR

SEQ ID NO: 1077 - protein, 13 aa, Corononavirus-HKU1
NSKSNFTSFALHN

SEQ ID NO: 1078 - protein, 16 aa, Corononavirus-HKU1
KLLRLSSSACPLIFSS

SEQ ID NO: 1079 - protein, 9 aa, Corononavirus-HKU1
KFGCKFKYL

SEQ ID NO: 1080 - protein, 14 aa, Corononavirus-HKU1
TCFNIFSFNISYGF

SEQ ID NO: 1081 - protein, 5 aa, Corononavirus-HKU1
IRFDS

SEQ ID NO: 1082 - protein, 4 aa, Corononavirus-HKU1
IVYY

SEQ ID NO: 1083 - protein, 5 aa, Corononavirus-HKU1
RLGWF

SEQ ID NO: 1084 - protein, 27 aa, Corononavirus-HKU1
GRSCYSRKHWNKLSTANRFFNWCGFCS

SEQ ID NO: 1085 - protein, 6 aa, Corononavirus-HKU1
SYWLIC

SEQ ID NO: 1086 - protein, 6 aa, Corononavirus-HKU1
ERLLYF

SEQ ID NO: 1087 - protein, 4 aa, Corononavirus-HKU1
KNCS

SEQ ID NO: 1088 - protein, 4 aa, Corononavirus-HKU1
SSSW

SEQ ID NO: 1089 - protein, 15 aa, Corononavirus-HKU1
TFNTPYVKRSKVGYC

SEQ ID NO: 1090 - protein, 6 aa, Corononavirus-HKU1
NCSNVI

SEQ ID NO: 1091 - protein, 6 aa, Corononavirus-HKU1
LSFRPF

SEQ ID NO: 1092 - protein, 10 aa, Corononavirus-HKU1
CSIYYLVCQF

SEQ ID NO: 1093 - protein, 8 aa, Corononavirus-HKU1
TYLFKVFC

SEQ ID NO: 1094 - protein, 5 aa, Corononavirus-HKU1
IRQRA

SEQ ID NO: 1095 - protein, 7 aa, Corononavirus-HKU1
SCYMLQF

SEQ ID NO: 1096 - protein, 9 aa, Corononavirus-HKU1
NWLLWLLAP

SEQ ID NO: 1097 - protein, 16 aa, Corononavirus-HKU1
STYCRYTTVGLYRFFN

SEQ ID NO: 1098 - protein, 5 aa, Corononavirus-HKU1
SRYNL

SEQ ID NO: 1099 - protein, 7 aa, Corononavirus-HKU1
RCTCCVS

SEQ ID NO: 1100 - protein, 10 aa, Corononavirus-HKU1
CNYDSLFSNL

SEQ ID NO: 1101 - protein, 9 aa, Corononavirus-HKU1
LEFRVSNNF

SEQ ID NO: 1102 - protein, 7 aa, Corononavirus-HKU1
GQYKYIL

SEQ ID NO: 1103 - protein, 7 aa, Corononavirus-HKU1
VIAACHA

SEQ ID NO: 1104 - protein, 5 aa, Corononavirus-HKU1
SCHAM

SEQ ID NO: 1105 - protein, 5 aa, Corononavirus-HKU1
IQLML

SEQ ID NO: 1106 - protein, 4 aa, Corononavirus-HKU1
HRQS

SEQ ID NO: 1107 - protein, 8 aa, Corononavirus-HKU1
RFSLCQRL

SEQ ID NO: 1108 - protein, 8 aa, Corononavirus-HKU1
CFSCSQVC

SEQ ID NO: 1109 - protein, 6 aa, Corononavirus-HKU1
TVILCL

SEQ ID NO: 1110 - protein, 9 aa, Corononavirus-HKU1
RWFMYVLEL

SEQ ID NO: 1111 - protein, 4 aa, Corononavirus-HKU1
FNCL

SEQ ID NO: 1112 - protein, 5 aa, Corononavirus-HKU1
HSSVK

SEQ ID NO: 1113 - protein, 6 aa, Corononavirus-HKU1
IKPSWM

SEQ ID NO: 1114 - protein, 5 aa, Corononavirus-HKU1
TCIPY

SEQ ID NO: 1115 - protein, 20 aa, Corononavirus-HKU1
AYAFFLLFRYALCVRRWFRI

SEQ ID NO: 1116 - protein, 13 aa, Corononavirus-HKU1
LRSFKKRHLYHTV

SEQ ID NO: 1117 - protein, 10 aa, Corononavirus-HKU1
SRWSCLFKAC

SEQ ID NO: 1118 - protein, 12 aa, Corononavirus-HKU1
YSYYSRLYFLGL

SEQ ID NO: 1119 - protein, 16 aa, Corononavirus-HKU1
FMEHFYYVTEFRKRNI

SEQ ID NO: 1120 - protein, 4 aa, Corononavirus-HKU1
CWSL

SEQ ID NO: 1121 - protein, 4 aa, Corononavirus-HKU1
WTYR

SEQ ID NO: 1122 - protein, 7 aa, Corononavirus-HKU1
ITLCYYE

SEQ ID NO: 1123 - protein, 4 aa, Corononavirus-HKU1
QSCC

SEQ ID NO: 1124 - protein, 6 aa, Corononavirus-HKU1
CRYCYF

SEQ ID NO: 1125 - protein, 5 aa, Corononavirus-HKU1
YIISY

SEQ ID NO: 1126 - protein, 5 aa, Corononavirus-HKU1
IVYKT

SEQ ID NO: 1127 - protein, 5 aa, Corononavirus-HKU1
YPAPP

SEQ ID NO: 1128 - protein, 4 aa, Corononavirus-HKU1
KFEH

SEQ ID NO: 1129 - protein, 11 aa, Corononavirus-HKU1
YLLEACPVGLC

SEQ ID NO: 1130 - protein, 6 aa, Corononavirus-HKU1
FHLWCL

SEQ ID NO: 1131 - protein, 14 aa, Corononavirus-HKU1
IHRFEVHRKFEYTF

SEQ ID NO: 1132 - protein, 7 aa, Corononavirus-HKU1
HWRFRSF

SEQ ID NO: 1133 - protein, 8 aa, Corononavirus-HKU1
KSKKWCFY

SEQ ID NO: 1134 - protein, 4 aa, Corononavirus-HKU1
VIND

SEQ ID NO: 1135 - protein, 5 aa, Corononavirus-HKU1
RSATS

SEQ ID NO: 1136 - protein, 7 aa, Corononavirus-HKU1
FKWCDCG

SEQ ID NO: 1137 - protein, 6 aa, Corononavirus-HKU1
SWRTQS

SEQ ID NO: 1138 - protein, 9 aa, Corononavirus-HKU1
VLVRYEKRW

SEQ ID NO: 1139 - protein, 20 aa, Corononavirus-HKU1
RCYLQPNRQPMLKPLLEPTR

SEQ ID NO: 1140 - protein, 17 aa, Corononavirus-HKU1
CSNTFYYLYSESCIVKF

SEQ ID NO: 1141 - protein, 10 aa, Corononavirus-HKU1
TSLRFRTGFY

SEQ ID NO: 1142 - protein, 4 aa, Corononavirus-HKU1
SVYC

SEQ ID NO: 1143 - protein, 8 aa, Corononavirus-HKU1
IWFRRLCI

SEQ ID NO: 1144 - protein, 5 aa, Corononavirus-HKU1
SYSLW

SEQ ID NO: 1145 - protein, 13 aa, Corononavirus-HKU1
SYRRFAFAYRLIS

SEQ ID NO: 1146 - protein, 4 aa, Corononavirus-HKU1
EKKI

SEQ ID NO: 1147 - protein, 9 aa, Corononavirus-HKU1
FVNSRVFTV

SEQ ID NO: 1148 - protein, 7 aa, Corononavirus-HKU1
YSFIFYY

SEQ ID NO: 1149 - protein, 4 aa, Corononavirus-HKU1
SGVW

SEQ ID NO: 1150 - protein, 6 aa, Corononavirus-HKU1
ECLYSY

SEQ ID NO: 1151 - protein, 4 aa, Corononavirus-HKU1
FIIR

SEQ ID NO: 1152 - protein, 5 aa, Corononavirus-HKU1
FCFYC

SEQ ID NO: 1153 - protein, 7 aa, Corononavirus-HKU1
VIKFELC

SEQ ID NO: 1154 - protein, 8 aa, Corononavirus-HKU1
GFSIYVVV

SEQ ID NO: 1155 - protein, 6 aa, Corononavirus-HKU1
NYDFLS

SEQ ID NO: 1156 - protein, 4 aa, Corononavirus-HKU1
NASH

SEQ ID NO: 1157 - protein, 11 aa, Corononavirus-HKU1
LETWLFYACFV

SEQ ID NO: 1158 - protein, 15 aa, Corononavirus-HKU1
VFECSIRESLFMELW

SEQ ID NO: 1159 - protein, 10 aa, Corononavirus-HKU1
FAYRLYDECC

SEQ ID NO: 1160 - protein, 17 aa, Corononavirus-HKU1
VHSIMSVFEYYNISCSC

SEQ ID NO: 1161 - protein, 10 aa, Corononavirus-HKU1
YACFTFRCRV

SEQ ID NO: 1162 - protein, 16 aa, Corononavirus-HKU1
RSSSRFCCFKTVVTIW

SEQ ID NO: 1163 - protein, 4 aa, Corononavirus-HKU1
YSCR

SEQ ID NO: 1164 - protein, 5 aa, Corononavirus-HKU1
FKPIC

SEQ ID NO: 1165 - protein, 13 aa, Corononavirus-HKU1
FSYLFWRLYDFTI

SEQ ID NO: 1166 - protein, 8 aa, Corononavirus-HKU1
LSLGFDNI

SEQ ID NO: 1167 - protein, 12 aa, Corononavirus-HKU1
GWVFYLHLSFNS

SEQ ID NO: 1168 - protein, 5 aa, Corononavirus-HKU1
IIFGW

SEQ ID NO: 1169 - protein, 12 aa, Corononavirus-HKU1
CSYKNYRVFLEC

SEQ ID NO: 1170 - protein, 13 aa, Corononavirus-HKU1
INELFCILDSFLY

SEQ ID NO: 1171 - protein, 5 aa, Corononavirus-HKU1
CKCFF

SEQ ID NO: 1172 - protein, 10 aa, Corononavirus-HKU1
RVFNRYKLPG

SEQ ID NO: 1173 - protein, 8 aa, Corononavirus-HKU1
NRWQCYAC

SEQ ID NO: 1174 - protein, 6 aa, Corononavirus-HKU1
LFVLEK

SEQ ID NO: 1175 - protein, 8 aa, Corononavirus-HKU1
YNMEWRCL

SEQ ID NO: 1176 - protein, 11 aa, Corononavirus-HKU1
IFFEIGWHCCC

SEQ ID NO: 1177 - protein, 7 aa, Corononavirus-HKU1
FKTRSIK

SEQ ID NO: 1178 - protein, 6 aa, Corononavirus-HKU1
FSLFSY

SEQ ID NO: 1179 - protein, 7 aa, Corononavirus-HKU1
IISSRYA

SEQ ID NO: 1180 - protein, 5 aa, Corononavirus-HKU1
RDFCW

SEQ ID NO: 1181 - protein, 14 aa, Corononavirus-HKU1
SCKYLLDLIKSKLC

SEQ ID NO: 1182 - protein, 21 aa, Corononavirus-HKU1
LFFYFFISVMVLMNLLMLCLI

SEQ ID NO: 1183 - protein, 19 aa, Corononavirus-HKU1
TMTGFYLVIVVLIVTILII

SEQ ID NO: 1184 - protein, 76 aa, Corononavirus-HKU1
KLKILIIWIFTLVCATMVRFHLVPVILFLRVFISLDFIITLAKVIKLFFMRVLILILIIDLSVFLMVVMMYGFLTR

SEQ ID NO: 1185 - protein, 56 aa, Corononavirus-HKU1
DFIVPYILIWPFFVILLLLIFLIMFLFLSLILVKVIFYHLTILFLLIILRKFILLY

SEQ ID NO: 1186 - protein, 5 aa, Corononavirus-HKU1
VVLFI

SEQ ID NO: 1187 - protein, 16 aa, Corononavirus-HKU1
YRFAFLNLTLVSTIIT

SEQ ID NO: 1188 - protein, 15 aa, Corononavirus-HKU1
ILALFMVFLMLFILI

SEQ ID NO: 1189 - protein, 150 aa, Corononavirus-HKU1
TVFIFLLNQVLIKFPPLHLFYPYLLKLSVLINLNNLYLYRLLILDGTTSVPQIFLYLLHVNCHIVIFAILLLIMLASMILTTVIVVLFLFYLVFYIMFLVFHIMVYFYMIILHPFGPIILLVGVLHLLLLNIQFVFMIFCLLFYKVFYYV

SEQ ID NO: 1190 - protein, 37 aa, Corononavirus-HKU1
LYFLLFFYYFCYITINLIKSKHVINYFYFAYNISCYR

SEQ ID NO: 1191 - protein, 9 aa, Corononavirus-HKU1
FKHHSSSHK

SEQ ID NO: 1192 - protein, 15 aa, Corononavirus-HKU1
VCCGCFLWFGYILYT

SEQ ID NO: 1193 - protein, 15 aa, Corononavirus-HKU1
SCLFKYYYIIYWLFP

SEQ ID NO: 1194 - protein, 5 aa, Corononavirus-HKU1
IWCQF

SEQ ID NO: 1195 - protein, 21 aa, Corononavirus-HKU1
GSIFKRYYIFEYSLVSETLFI

SEQ ID NO: 1196 - protein, 4 aa, Corononavirus-HKU1
WYFF

SEQ ID NO: 1197 - protein, 5 aa, Corononavirus-HKU1
YYSYR

SEQ ID NO: 1198 - protein, 10 aa, Corononavirus-HKU1
QLLYYCCSTS

SEQ ID NO: 1199 - protein, 13 aa, Corononavirus-HKU1
WCFGDYSLSIHYV

SEQ ID NO: 1200 - protein, 6 aa, Corononavirus-HKU1
VSSYYL

SEQ ID NO: 1201 - protein, 4 aa, Corononavirus-HKU1
ILAF

SEQ ID NO: 1202 - protein, 11 aa, Corononavirus-HKU1
TFVSVQEKFYL

SEQ ID NO: 1203 - protein, 22 aa, Corononavirus-HKU1
CFYRLVVFSFLSRTWHFLCLLC

SEQ ID NO: 1204 - protein, 9 aa, Corononavirus-HKU1
FWHAYYFFI

SEQ ID NO: 1205 - protein, 17 aa, Corononavirus-HKU1
FVSWYSFISLLCFAFDL

SEQ ID NO: 1206 - protein, 4 aa, Corononavirus-HKU1
CYIF

SEQ ID NO: 1207 - protein, 10 aa, Corononavirus-HKU1
DFTILGHTFV

SEQ ID NO: 1208 - protein, 5 aa, Corononavirus-HKU1
TPISS

SEQ ID NO: 1209 - protein, 6 aa, Corononavirus-HKU1
QPWCYY

SEQ ID NO: 1210 - protein, 4 aa, Corononavirus-HKU1
RDSM

SEQ ID NO: 1211 - protein, 4 aa, Corononavirus-HKU1
IFIT

SEQ ID NO: 1212 - protein, 4 aa, Corononavirus-HKU1
YWCL

SEQ ID NO: 1213 - protein, 6 aa, Corononavirus-HKU1
LIWFYC

SEQ ID NO: 1214 - protein, 10 aa, Corononavirus-HKU1
ACCNCTSSYS

SEQ ID NO: 1215 - protein, 5 aa, Corononavirus-HKU1
CTLTS

SEQ ID NO: 1216 - protein, 10 aa, Corononavirus-HKU1
FEYFASFSSY

SEQ ID NO: 1217 - protein, 4 aa, Corononavirus-HKU1
FFFL

SEQ ID NO: 1218 - protein, 5 aa, Corononavirus-HKU1
EYCFR

SEQ ID NO: 1219 - protein, 9 aa, Corononavirus-HKU1
ICHTQLQTI

SEQ ID NO: 1220 - protein, 12 aa, Corononavirus-HKU1
FAVGQFWFSAIF

SEQ ID NO: 1221 - protein, 6 aa, Corononavirus-HKU1
FLSIVL

SEQ ID NO: 1222 - protein, 4 aa, Corononavirus-HKU1
FACN

SEQ ID NO: 1223 - protein, 5 aa, Corononavirus-HKU1
SFFLE

SEQ ID NO: 1224 - protein, 4 aa, Corononavirus-HKU1
KVWF

SEQ ID NO: 1225 - protein, 4 aa, Corononavirus-HKU1
FELS

SEQ ID NO: 1226 - protein, 10 aa, Corononavirus-HKU1
CCLLTLLFFC

SEQ ID NO: 1227 - protein, 6 aa, Corononavirus-HKU1
YFLSLC

SEQ ID NO: 1228 - protein, 10 aa, Corononavirus-HKU1
TFFCFKLQES

SEQ ID NO: 1229 - protein, 10 aa, Corononavirus-HKU1
TTFCFLSYWY

SEQ ID NO: 1230 - protein, 4 aa, Corononavirus-HKU1
LSFL

SEQ ID NO: 1231 - protein, 8 aa, Corononavirus-HKU1
EYYCTRPH

SEQ ID NO: 1232 - protein, 5 aa, Corononavirus-HKU1
VFLFT

SEQ ID NO: 1233 - protein, 5 aa, Corononavirus-HKU1
SYNCL

SEQ ID NO: 1234 - protein, 12 aa, Corononavirus-HKU1
VLFSKKVSGWCW

SEQ ID NO: 1235 - protein, 7 aa, Corononavirus-HKU1
TLCRVRC

SEQ ID NO: 1236 - protein, 10 aa, Corononavirus-HKU1
RKVWCIGWII

SEQ ID NO: 1237 - protein, 5 aa, Corononavirus-HKU1
CFLSL

SEQ ID NO: 1238 - protein, 7 aa, Corononavirus-HKU1
CLSRLVL

SEQ ID NO: 1239 - protein, 4 aa, Corononavirus-HKU1
HLRQ

SEQ ID NO: 1240 - protein, 7 aa, Corononavirus-HKU1
FYFKWYQ

SEQ ID NO: 1241 - protein, 5 aa, Corononavirus-HKU1
WYHLF

SEQ ID NO: 1242 - protein, 4 aa, Corononavirus-HKU1
FIAA

SEQ ID NO: 1243 - protein, 12 aa, Corononavirus-HKU1
LRPLWYYRTRYF

SEQ ID NO: 1244 - protein, 7 aa, Corononavirus-HKU1
RSFCCLL

SEQ ID NO: 1245 - protein, 6 aa, Corononavirus-HKU1
LAKSFV

SEQ ID NO: 1246 - protein, 6 aa, Corononavirus-HKU1
WQHYWF

SEQ ID NO: 1247 - protein, 4 aa, Corononavirus-HKU1
RFCY

SEQ ID NO: 1248 - protein, 25 aa, Corononavirus-HKU1
YFPLLCRKSFCCFSSKCFLFGFTLS

SEQ ID NO: 1249 - protein, 4 aa, Corononavirus-HKU1
LCFE

SEQ ID NO: 1250 - protein, 9 aa, Corononavirus-HKU1
YFFNYSAIF

SEQ ID NO: 1251 - protein, 6 aa, Corononavirus-HKU1
LSWLRF

SEQ ID NO: 1252 - protein, 11 aa, Corononavirus-HKU1
LFCFFLCSSHG

SEQ ID NO: 1253 - protein, 4 aa, Corononavirus-HKU1
WFLC

SEQ ID NO: 1254 - protein, 9 aa, Corononavirus-HKU1
LTFFFLFAS

SEQ ID NO: 1255 - protein, 11 aa, Corononavirus-HKU1
KYFCFLSFCYF

SEQ ID NO: 1256 - protein, 4 aa, Corononavirus-HKU1
CQFC

SEQ ID NO: 1257 - protein, 6 aa, Corononavirus-HKU1
VCGWSL

SEQ ID NO: 1258 - protein, 5 aa, Corononavirus-HKU1
DQNSH

SEQ ID NO: 1259 - protein, 12 aa, Corononavirus-HKU1
LYYSWSRGIYSN

SEQ ID NO: 1260 - protein, 7 aa, Corononavirus-HKU1
LFFICLF

SEQ ID NO: 1261 - protein, 5 aa, Corononavirus-HKU1
LCSLP

SEQ ID NO: 1262 - protein, 9 aa, Corononavirus-HKU1
LIVRVWHFL

SEQ ID NO: 1263 - protein, 7 aa, Corononavirus-HKU1
YYSIACS

SEQ ID NO: 1264 - protein, 8 aa, Corononavirus-HKU1
YSYARCHT

SEQ ID NO: 1265 - protein, 18 aa, Corononavirus-HKU1
IPSWMFRSTLRFFFSFFF

SEQ ID NO: 1266 - protein, 4 aa, Corononavirus-HKU1
RFIV

SEQ ID NO: 1267 - protein, 7 aa, Corononavirus-HKU1
TFRCWFC

SEQ ID NO: 1268 - protein, 5 aa, Corononavirus-HKU1
QLYWW

SEQ ID NO: 1269 - protein, 8 aa, Corononavirus-HKU1
RSSLCTIL

SEQ ID NO: 1270 - protein, 7 aa, Corononavirus-HKU1
SFASYFV

SEQ ID NO: 1271 - protein, 29 aa, Corononavirus-HKU1
ISNFWLHHSRYCCCYVSTMVSSSWHTIFS

SEQ ID NO: 1272 - protein, 9 aa, Corononavirus-HKU1
WFGCYYGCS

SEQ ID NO: 1273 - protein, 9 aa, Corononavirus-HKU1
KSKVDSYCF

SEQ ID NO: 1274 - protein, 9 aa, Corononavirus-HKU1
CSSFYSEWF

SEQ ID NO: 1275 - protein, 7 aa, Corononavirus-HKU1
CYQLCTC

SEQ ID NO: 1276 - protein, 5 aa, Corononavirus-HKU1
NTKCC

SEQ ID NO: 1277 - protein, 4 aa, Corononavirus-HKU1
CSST

SEQ ID NO: 1278 - protein, 6 aa, Corononavirus-HKU1
FVTAII

SEQ ID NO: 1279 - protein, 4 aa, Corononavirus-HKU1
IWCN

SEQ ID NO: 1280 - protein, 19 aa, Corononavirus-HKU1
FFFTRNFISSRCFRGSGSD

SEQ ID NO: 1281 - protein, 14 aa, Corononavirus-HKU1
WSFNCFKCLCLSTA

SEQ ID NO: 1282 - protein, 15 aa, Corononavirus-HKU1
YFSCKIWCCFSYGEG

SEQ ID NO: 1283 - protein, 6 aa, Corononavirus-HKU1
KSISSY

SEQ ID NO: 1284 - protein, 18 aa, Corononavirus-HKU1
SYFVISSKCSLWFVVYAF

SEQ ID NO: 1285 - protein, 4 aa, Corononavirus-HKU1
TYFF

SEQ ID NO: 1286 - protein, 12 aa, Corononavirus-HKU1
NCFSKSWFVYIR

SEQ ID NO: 1287 - protein, 5 aa, Corononavirus-HKU1
CRYCT

SEQ ID NO: 1288 - protein, 5 aa, Corononavirus-HKU1
TRVFY

SEQ ID NO: 1289 - protein, 6 aa, Corononavirus-HKU1
SLDVHW

SEQ ID NO: 1290 - protein, 5 aa, Corononavirus-HKU1
FLLLS

SEQ ID NO: 1291 - protein, 4 aa, Corononavirus-HKU1
TNFR

SEQ ID NO: 1292 - protein, 10 aa, Corononavirus-HKU1
KCCFYEYLFC

SEQ ID NO: 1293 - protein, 14 aa, Corononavirus-HKU1
SASCLFESFCTKIV

SEQ ID NO: 1294 - protein, 5 aa, Corononavirus-HKU1
VISLV

SEQ ID NO: 1295 - protein, 7 aa, Corononavirus-HKU1
KSNIHCA

SEQ ID NO: 1296 - protein, 8 aa, Corononavirus-HKU1
FDFKSSYY

SEQ ID NO: 1297 - protein, 8 aa, Corononavirus-HKU1
CYFFRFVL

SEQ ID NO: 1298 - protein, 8 aa, Corononavirus-HKU1
DESYSRVY

SEQ ID NO: 1299 - protein, 4 aa, Corononavirus-HKU1
LYQS

SEQ ID NO: 1300 - protein, 5 aa, Corononavirus-HKU1
RYRYI

SEQ ID NO: 1301 - protein, 38 aa, Corononavirus-HKU1
NVCKMALVCLATNFFFIYNIPCIALFYMLLYWLWFCMF

SEQ ID NO: 1302 - protein, 5 aa, Corononavirus-HKU1
VWWSS

SEQ ID NO: 1303 - protein, 7 aa, Corononavirus-HKU1
FCYQNIS

SEQ ID NO: 1304 - protein, 8 aa, Corononavirus-HKU1
LESLVRSH

SEQ ID NO: 1305 - protein, 112 aa, Corononavirus-HKU1
TLFMDVWRPSYTHSLVIREFGVTNLEDLCLKYNYCQPIVGYCIVPLNVWCRKFGKFASHFTLRSHDISHSNNFGVVTSFTTYGNTVSEAVSRLVESASEFIVWRAEALNKYG

SEQ ID NO: 1306 - protein, 4 aa, Corononavirus-HKU1
FIFQ

SEQ ID NO: 1307 - protein, 29 aa, Corononavirus-HKU1
YCLVHRTDFSFSFILSYFFNLCCCFFSNY

SEQ ID NO: 1308 - protein, 9 aa, Corononavirus-HKU1
ALYATLWFL

SEQ ID NO: 1309 - protein, 11 aa, Corononavirus-HKU1
FLYYFTFGLRL

SEQ ID NO: 1310 - protein, 6 aa, Corononavirus-HKU1
KRYAVV

SEQ ID NO: 1311 - protein, 239 aa, Corononavirus-HKU1
TSYTTHFRLFNLNLNIMNKSFLPQFTSDQAVTFLKEWNFSLGVILLFITIILQFGYTSRSMFVYLIKMIILWLMWPLTITLTIFNCFYALNNAFLAFSIVFTIISIVIWILYFVNSIRLFIRTGSWWSFNPETNNLMCIDMKGKMFVRPVIEDYHTLTATVIRGHLYIQGVKLGTGYTLSDLPVYVTVAKVQVLCTYKRAFLDKLDVNSGFAVFVKSKVGNYRLPSSKPSGMDTALLRA

SEQ ID NO: 1312 - protein, 444 aa, Corononavirus-HKU1
TIRMSYTPGHYAGSRSSSGNRSGILKKTSWADQSERNYQTFNRGRKTQPKFTVSTQPQGNTIPHYSWFSGITQFQKGRDFKFSDGQGVPIAFGVPPSEAKGYWYRHSRRSFKTADGQQKQLLPRWYFYYLGTGPYANASYGESLEGVFWVANHQADTSTPSDVSSRDPTTQEAIPTRFPPGTILPQGYYVEGSGRSASNSRPGSRSQSRGPNNRSLSRSNSNFRHSDSIVKPDMADEIANLVLAKLGKDSKPQQVTKQNAKEIRHKILTKPRQKRTPNKHCNVQQCFGKRGPSQNFGNAEMLKLGTNDPQFPILAELAPTPGAFFFGSKLDLVKRDSEADSPVKDVFELHYSGSIRFDSTLPGFETIMKVLEENLNAYVNSNQNTDSDSLSSKPQRKRGVKQLPEQFDSLNLSAGTQHISNDFTPEDHSLLATLDDPYVEDSVA

SEQ ID NO: 1313 - protein, 5 aa, Corononavirus-HKU1
ILIRH

SEQ ID NO: 1314 - protein, 9 aa, Corononavirus-HKU1
VVTPRYYSE

SEQ ID NO: 1315 - protein, 10 aa, Corononavirus-HKU1
DTLYQNEFLL

SEQ ID NO: 1316 - protein, 38 aa, Corononavirus-HKU1
VVTDYILISRNFIFRHLIVRVVIRFSCSINASGKSYQL

SEQ ID NO: 1317 - protein, 9 aa, Corononavirus-HKU1
CLIYILVYD

SEQ ID NO: 1318 - protein, 11 aa, Corononavirus-HKU1
PFGGITKKKKK

SEQ ID NO: 1319 - DNA, 29942 bp, Corononavirus-HKU1
  CDS (1)..(29940)
ttttttttttttttttgtaattcctccaaaaggctataattaatttcaatcatatactaatatatatattaaacactacaattgatagctcttcccggaggcgtttatactacagctaaaccttataactactctaacaatcaaatgtctaaatataaaatttctactaattaatatatagtctgtaacaacctactctatctgttattacagcaagaattcattctgatagagagtgtcctattccgaataatagcgaggggttaccacctagtgtcgaattaggattcattctcattaagcaacagagtcttctacataaggatcatcaagagtagcaagtaaactatgatcctcaggagtaaaatcatttgaaatgtgctgagtaccagcacttaaattaagagagtcaaactgttctggtaattgtttaacacctcttttacgctgaggtttagaactcaacgaatcagaatcagtgttctgattagaattaacgtaagcatttaaattctcttcaagaactttcataattgtctcaaagcctggtaaagtactatcaaacctaatagaaccagaataatgaagttcaaaaacatctttaacaggtgagtcagcctcggaatctcttttaaccaagtctaatttagaaccaaagaaaaaagcacctggtgtaggagctaattctgcaagaataggaaactgaggatcattagtaccaagctttaacatttcagcattaccaaaattttgagaaggtcctcttttaccaaaacactgttgaacattacaatgtttattaggagttcgcttttggcgaggttttgttaaaattttatgcctgatttccttggcattttgcttagtgacttgctgaggtttagaatctttaccaagcttggctaaaacaagattagcgatctcatcagccatatcaggttttactatagaatctgaatgtctaaaattagaattacttctacttaatgaacgattattgggtccacgtgattgagaacgtgaacctggtcgactattagaagcagaccttcctgagccttcaacataatagccttgaggcaaaatcgtaccaggcggaaacctagtagggatagcttcttgagtagtaggatcccttgacgaaacatcggagggagtagaagtgtcagcttggtgattagcaacccagaagaccccttcgagggattcaccataggatgcattggcatatgggccggtaccgagatagtagaaataccatctcggtaacaactgcttttgttgaccatcagctgttttaaaagaacgccggctgtgtctataccaatatccttttgcttcagaagggggtactccgaaagcaatgggaactccttgaccatctgaaaatttaaagtctctacctttttgaaattgagtgatcccggagaaccaggaataatgtgggatagtatttccttgtggttgagtagacacagtgaatttaggttgggtttttctgcctctattaaaggtttggtaatttcgctcagattggtcagcccaagaagttttcttgaggattcctgaacgatttccagaggagcttctacttccagcataatgaccgggagtataagacatcctaatagtttagatttaagctcttaacaaggcagtatccataccactaggtttactagacggtaaacgatagttaccaactttagacttaacaaaaacagcaaaaccactattaacatctaacttatctaaaaaggcacgtttataggtacaaagtacttgcaccttagctacagtaacatatacgggcaaatctgaaagagtataaccagtgccaagtttgacaccctgtatataaagatgaccacgaataacagtagcagttaatgtgtgatagtcctcaataactggcctaacaaacatcttgcctttcatatcaatacacataagattattggtctctggattaaaactccaccaactgccagttctaataaaaagccgaatactattaacaaaataaagaatccatataacaatagaaataatagtaaacactatagaaaatgcaagaaaagcattattcaaagcataaaaacaattaaatatagtcaaggtgatagtcaatggccacataagccaaagaataatcatcttgataagataaacaaacatactacggctcgtataaccgaactgcaatatgatagtaataaaaagtagtattacacccaaagagaaattccattcttttaagaatgtaacagcttgatcagaagtaaattgaggaagaaaagatttattcataatgtttagatttagattaaataatctgaagtgggtggtataacttgttcactataagacttatacaactgcatacctcttttataaacgtaagccgaaggtgaaataataaagaaattacaaaaaccacaaagttgcatacaaagcttaatagttgctaaaaaagcaacaacaaagattaaagaaataagacaaaataaaactaaaactaaaatctgtcctatgtaccaagcagtatcattgaaaaataaatcaaccatacttattaagtgcctctgcacgccaaacaataaattcagaagctgattcaactaatctagacacagcctcagaaacagtattaccataagtagtaaaactagttacaacaccaaaattattactatgggaaatatcgtgactacgtaatgtaaagtgagaagcaaatttgccaaacttgcgacaccaaacatttaaaggtacaatacagtaaccaacaataggttgacagtaattatactttagacacaaatcttcaaggtttgtaacaccaaattctctaataacaagagaatgtgtgtagctaggtctccaaacgtccataaataaagtttagatttaatgagatctgacaagagattctaatcatcatgagatgttttgataacaaaatcatgatgaccaccatactcatcacaacaattatgacatttactaaaacatgcagaaccacaaccagtacaacaacatataaaaaagagcaatacaaggaatattataaatgaaaaagaaattagtagccaaacataccaaggccattttacatacatttcatatgtacctatatctttaagattgatataactattattcaaagacttaatagactcttgaataagattcatctcataatacaaatctaaaaaagtagcattaatagtatgaagatttaaagtcaaattaggcgcaatggatgtttgatttttaaaccaatgagataactcagattcaaaatcagacaattttggtacagaatgattcaaataaacaagaggcgctttagtaaaattaacagaacaagtattcataaaaacaacatttttatctgaaattggttcaggataatagtaagaactaccagtgaacatccaatgatcattatgtttaataaaatacccttgtttaggtgcaatacctacatcacctgatatacacaaaccaggacttactaaaacagttttaaaagaaataggtttataactaaaatgcataaacaacaaaccataaggagcattttgaactaatgacaaaatatgattaccattaccacaaaaattaatacgaggagattgacttttaacacactcattaaccttctccatagctaaagcagcaccaaattttacaagagaaatatcactaagctgttgagagacataagcatttaaagcagttaaacgaccattaataagcctatcaatctgaacctgagcctctaaagcatcgagacgagataaaatttcttgtaaagaagaactaattgcaccaaatttattaaataattgctgtaacaaactattaagtgcttgagcattagaattaacaacactttgtattttagcaagtgcagagttggtagcactaaaaccattctgaatagaaagaagagcattattaaaagcagtagctatcaacttttgatttttattaagaacatccatagtaacacccaaaccattaattctatattgtacattaagagaaaatggtatgccagctgctgctgaccatggtggaaacatagcagcaacagtagcggctgtggtgtaaccagaaatttgagattcagacaaaataggaggcaaaactttaataccattaaaggattgtacacaaagaagatctctaatttcactaccaccagtacaattgttataagcttcaacaaaaccaacatctgaaagtttaactttgtcaaacaataaatcttcaaaaaaagaacgagaagaagaaccgcagtgtggacctaaacatccaactagggatttaaaattaatattatcaacatcaaaatgcaaattagtattaagattggagctaagtgtgacaccttgcataagagtatcagctacatgcaattgagtagtatcaagtaaaccattaacttcatctaaaatactattaatattatcacaaaaagtgccatactctgacaataagtcatggcaagctgcataattagaacagacaaataaagaacaatcaatagtaactttaggagaattagtttgaataaattcctcttgaccaactatagtaaagttagtgggaattttgatctcataaagaccacccacagactcaatactgtcattaacaaaactgacattaaagggttcaaaagtaacaaaacgataagaagcagaaatacttctacgtttacgacgcgaagaggaagaagaaggtgagttataatcaacacaaaaaccactacccatgcgaagagcacaagaagaaacagaataatcagttaaattatcagcattaaaaacgcaaccaagataactatcaaaatatggctgagtagttaaagaaatattattcaaaacatagctacattttaaattacgataaagtaaagccaaagaggaagcattttgatgaaaagcagcagaaactcttcctgcataacaagggaaaatattatatgttttattagtaacaaaatctttaaaaccaataatgttgccattagaatcatacaaaagattttgccaactattataataaacagcagaaacttctttaaaaataccttgtcctgtaataccataaaggtcgtaatcaacacaaacatcagtaaaaacttcagtattaggctgcaataaatcattagaacaagtggtaccactattgataccatttaaaataaaattagaaaaaatattacaacggttgttactgacgcaagtgtcataagaccaacctagaaaggcatcagtactacaaagacaagaaacattatatgatccatccaatacaccacacttttcttcatcaacaccgaaccctgcacaatgttcaccaacaccaaccagagactttttttgagaacaagacctagggtcataagcagttataggatcaggtaaacaagaacacctacaccagtcagtgtggtcgagtacagtagtactctcacaagaacgataattagtaccaataggacaggaagcagaaggtggtttatgactcttgcaacttgaagcaaaagaaggtttagcacaaggacaaaaagtattattaacagaaaaacaataacgtgagtaaacaacactatgagagctcaaattaaaattattaaaaccataccttctattccaagaagaaggattataattattaatagtaacattaattgcaggcaaactataatacaattgacaagaactagaagtagtgtcaattttataattagaagattgcagaaaaccagaactgcccaactgcaaatcagatcgtctggagttgggtatggcaaatttatctaaaacaatactcttaaaacaactaccatatatcttagattcatcaaaattattacaagaaaaagaatcagtatgaactaaacgaagcaaagtactcaaattaaagttgcaattagaaaaaattttacgttcccaattaagaggtgagggtacattaaaattgttaagccatttatcaatgtcacaatcaggtaaatcaggaatacgacgatgtacagttgcaacaggcttaacagtaaaaccagataagtcataaacaccagtattaggtaataaagatttagttttacattgaatctcgctaaagaaactactagaacaatcaacagcattagtaataacaccacggttgtcaaatttaagaagatattggcgtttagacaaaggtgtgacccaatattgtaaagtctcattatcagtattagaagatatagcattacaagtcaaaggcaaaacataataatgagataaaagagtaccaagatacaaactaaataaaaaagtagtaggcatgccagaatcagcataataagcataaaaagtgccacgttcttgataaaaatgaaaatacaaccaatctgtagaaacattataagtaaaatttttcttgaacagacacaaaggttcagatttatcaaaatgccaagattcattacgagaactacctttagatttacaaatagtatgaggatactcacacatagtgtattgacaagctgtaatctccaaaacaccattatgaggttgaacaacaatagtataagagttgttaataaaaacactacctataactatagtactaaactcactatacaaagttttattaacatacaacttagtattcttaactctagaaaaaataccattattaaaatcagataaaaagggtttctgataccaaagagtactcaaatatgtagtaccttttaaagatagatccctaaaattggcaccagatttagggaaataaccagtaaataatatagtagtatttaaataaacacgatcaagtatataatatgtacccaaaccataagaaacatccacaacatactcacttatgcgaggaactgtggtgtttaaatcattaatagcaaaattagtacaattaaaatcacctataacagctaatgttgtaggcaaaataaaaataattaataacatgtttagatttaatgagatttatcgttatataacaaaaataatagaaaaacaacaaaaagtaaagctaaacataataaaataccttgtaaaataataggcaaaaaatcataaacacaaattggatgtttaataatagaagatgtaggacacctaccaaaagaataatagggccaaatggatgtaaaattatcatataaaaatacaccataatatgaaatacaagaaacattatataaaagaccagataaaatagaaataaaaccactatcaccgtggttaatatcatacttgccaacataattagcagaagaattgcgaaaataacaatatggcaattgacatgcaacagataaagaaatatctgaggcacgctcgttgttccatctagaatcaacaacctgtacaggtacaaattgtttagatttatcaaaacagagagctttagtaggtaaggataaaaaaggtgcagtggtggaaactttataagaacctggtttaagagaaatataaatacagtctaaatcaggataaacaacattagaaaaaccataaacagagccagtatctatgttataatagtactgactaaagttagatttaaaaaggcaaagcggtactaaataaagagaacaacctaataaagtaaaataaacttccttagaataattaataaaaataggattgttaagtgataaaatatcacttttacaagaattaaacttagaaagagaaacattataaggaatatcaacaaaagtaagataacgaaaaaaggccatattagaatataaggcacgataaaatcttaccttgttaagaagccatacatcattactaccattaggaaaacacttaaatctatgataaggattaaaattaacaccctcataaaaaataatttgatcaccttcgccagtgtaattataaaatcgagtgaaatgaaaactcttaaaaatagaatcaccggcactagatgaaatcttaccattgttgcacaaactagggtgaatatccaaataatcaaaatttttaatttttaaattattaatatggttacaatcagaacgactatcaccaaataaaaaccagtcatggtttaaatgagacacaacattaagaggttcattaaaaccataacagaaataaaaaaataaaaaaataattaacatagtttagatttaatgagatctaacaagtatttacaagactatcaccaacaaaaatctctttacgcgtatcgcgaactaataatttacctctttcaataagagaataaactaaatcatttaattgatctggtcttaaattaacaacagcagtgccagccaatttcaaagaaaatttagtcatatcaaataaactataagcaccgccattccatgttgtactatttctccaaaacaaatagttagcatgcataacattgccatctatttcaaaagaagatttacccaggtaatttatacctattaaaaacccttcactagaagaagcatttacattagtacaaaaaactgtccaaaatgcaaaacaactcattaatttatataaatcagcattccaagaaaactctgtaatttttatagctacactaccacccaaagataatttatcacgaattaaatgacaaatgtaagtaaaaaacccatccttactcacattataatcaccaatatttttagtaagaggatcatacatatcagatattatcaaatcccaatgacaatcaaatggtaaagtcatacaatctccaaaataagtaactaaactatcgctaacaaatgggtttaaatcattatctacaagaatactaccagatggtaaccactgtcttaaaacagcagaacctggagctacttctttatcagaccctgcacctaaatgtaaaacacgcatattaacaggaacagctaatgttgtagtattcaaatactgacataattgagtgtacttagcaacattcatcatacagcctgtaggcaaattaataggtttaccataattccataaagagactctctctaatggaacattcaaatacttatacaaaacaggcatagaatagccaggtttccaatcattagtggcttgcattttaggataaaaagtcataattttattatcattacaccacaacataaattgaaaatccttaaaatcaacattaatattaacaactttactaacacaactcaaatttaatgacttaacaatagaaacaaaatcatctaataataaatcaataactgtacaaacactcttactactaccacactcctgatcagtaataaaatatgaatgaatactagaatcatactgtaaaaactcttgaattaacaaattagatttttttttcctacgaaataagcctataagcaaatgcaaacctcctataactttatggttaaaactaccataaactatatgatcaaatgcatagtcttctaaaccatatttagcaataaacagattatcatccatatcaataaaatcccgttctaaatctgagcgaggttcaaaacttgacaatacacgactctgagtaaagatagtaaaacgtgttagagcatcattaccaatgacattacccgcgcaattaccacctagattaccttgtgggctccagtaatggcttgagcataggctgtctgttcggctgaagataacatcgtcaccatcttttctcatagcgaaccaaaactcaactttgagttctccaactttatccacaatcacaccatttaaatcagctcgttgcggacctttaatcattgataacctacttaatttttcagtactaataaaaacaccatttcttgcttttctaaaagcttctaaagcgccagtgtcacgaccatcaaaaagtatattcaaattttcgatgaacttcaaatctgtgtatttacaaacaccataagtggaactacaaaacaaactatctttaacataatcccacaggacatgcttccaacaaatatcaatgttcaaatttctaagaatcttaagttcagggtggtgccggatactacgttttgtaaacaattcaacagctatattagtaggaaatgatgtattatttttaaaaataacagtatctacattattaatcttaacaacaactttgtcattcataatagcacaaggtaattcacctgtacgtccatcataatgaccaacattaaccaagttatatattacgttttctaaactctgtaacgtagtaaaagtgttccataaattataaaaatcaaaattcttataaacccaaaaagtaaagcctgctgtagtaactatattataagactcaaggtagttacaatattcttcagcatgctttgaacaaacagctccacctagattacaccgtgtgatacaagtggcgcttcttaaaggaacgtaatcaacttgtttagattctaaaccatctacgtacacacaaggcgtatctgaataatagaaaaaaggcataggcttaagattttcaaaaacagttctagtaaaaggattagtatggaatgcatgtttattaacatacaaactaccaccattacatccaggaaggtttaatttatttaacactcgagtgtcaaatctacaaacaattgaattagatggatatttatcaacattacaattccaaaacatacataaaccatctttaaaattatctttatgcacatcatagacataaaataactgtttaacagacttggctacaggaaaagcatcataaaatttaaattcataatctttgacacaagctaaacctttaggattgcctatgtcataacataagttgtatctattacatagcatggcagctttaagcatgacacgctgcaataacctacaagatgtatttatactgacctcattagaaattattggatactctaaattccaattaacagatttacaaaaacaatcatagattgctaaacaacgagtcataattgcatcagctgacgcaacatgtgcacctttatgtacattacaaattatatcgtgattactagttaaagaacctgtataaccccactgttgtatatctacaataagtggattatacacataatcacaagtataactatggcgccaacaaccataataaccagttctagaattgtagcatgtagcacgattagaacacacattacaattaagctctctgcctaatttagcaaaataccttaaacaagtaagttcaaaactggcagaccaagtaataaatactacactatcagaaaggtctaaaagataatcagataacatttgaacaattctaattctaacaatatcccacttttgaccttttgacataaggggtattaaatgtttaaatttttcaccaggaggagctttagctacagtttttttaaaagtataacaatctctctcagcaaataagccagtagcttcaactacaaaatccacaccagttgaaaaacctatttgcagtggaaagtttgttccaatgttttcgcgagtagcatgagcgccctcaacatcaaaaccaacccaacctctaacacgtttaatggcttcatctttagtaataaacaatttagaataaccatcaagagtcaaatctaatttaaaacccataagagatattaaacgagaatatgttaaaacaggttcacaaatatttaaatttacagccaaattttcattaaccttatatttatcatcaactgctaaaaatgagggggcatgcgctggatgataacctaagcaacttttactacaatctttaaaaagattagttgtgcaatgcaaacgaggtaaagtttgattttgaattttatctaaaggtagagtaataaaattaagagattcaaataattgcatattactcataacacaaaaaatgcccttcttggctctagttatggcaacattaaatcgattaacattaacagaatgggctgtttctgctgtttgtgaatatataacataatcatattccgaaccttgagcagaatctacagtttgtgtttgaacacctaaaacacgcttagcaacataattctgactattataaggactaataaaaacagcactattccaaactggattagcttttaaaaatttactaattagatatatctgttgaatatttacagcacttgaactctcatgtgttgtctgtcccttaaaatatactttaaaacataatgaactattatcatttttagccttgagtttattatcataaaccaatgctgaaacagtttctacaatttctttaggacacctataacaatttcccaaaaagatatcaggacctaaacaacacattattttagtaatagaattgaagtgcctaggttctaaagaacccttgctcaacagcacacgtggtgcaggtaattgagcaggatctccaatatatacataatgtttagctttaatacgagcatttataacagacaattcataattagtaagcatactaacttcatcaacaacaacaatatctgtaaccaactctggtaatgcatttattgtggtaaaaacatacttacaagtggtatcattaattttaaacttatcataacaatctacacgaactttagcaggaataatacgtgtacaatcgttaatatttaaaaacttataagctttttcacacaatgcatctacagcagcatgactagcagcagtataaactacacgtgctgtgtagtaataaacagctagacctatagcaagatgagactttcccgtaccagggggaccttgaacagtgcaataacgtttcattccaatgtgctgataattagcaacattattttgaaacaccaatggaacactataaacactagaaaatcttatactagcatagttctcttgtgggacaagtgtaggtgcacttaaactagctacagaatgtgatgttaaaacaaaaacatcacctatagaaagtttataagtagttgtagcgcggtaatacacaccgttagttaattcacttttatcaaaaacatactcacctaaaactgtcttaccagtactagtaaaatggtagcctgtgaaaacataatttttattaagtggtggtttaactttacctgtctcccaacacaaaataacttctctatcactaacaatctcttgaatggtagcagaagcatagctttgtttaaaagcctcttcagttgccttttgagtttctgcagcaaataactttaaacgttcaatacactcatttgccagaacataatcatcaacttctgtccatttacaactagctatcttattaaaatcatctatataaggtgaacccgtgcaagattgtttatacaaaccaaagaccataccattcataactaacttaaatgaataatggggtttatggttttcacaatagtaagacataccgcccaaatataatttggtgacatcactcacatcacagttaggtgcattacaaacgtaaggtgagacactcaaaacatatttatgattagttgccataacatggtcataacaacatttacaacataacaaaggcttacgtatacaactgccacaacgcaaagaagtttgtgatgaacaaacaacgcatgcacctacactctgcatcacggcactttttaaatacatattcttgtaaaatgattcttcagtaaactttaaaccatcacaagtacttaaaataacactataactatctaagatctgagtaccaagatcattatacagtttttttatatattctaaatatacacgaaagactttttggtattcttcattttcatgatgtactaaagggtaagcatctatagctagacttacaaagcgctctatcaaaagaacactgtcagtcttcaataaatcatcaacaaaacaaccagctcctaaaattctagaaggatctggatatggtaaataaacataatcaccatctatcttaactaacatagtatgttgggaacaaaattcatgaggaccattagtaatatcattttcaacccaacatttagattcagacataaagacattattctgatagtacaaaacttgttgaaaaacacttatattagctatataacccttactagcataatcagagttataacagacaacaccatcatcactcaaaatcatcatactaaaatgcttacataaaaattcataatactcattaacaaatgtataatcaacataatctgtacgataaacattagagtataagcgtttttgtaaattgcgtatacttaaatcttcaatcttatggccattacaggccataagagaacaaacattagcagtaacagcctgacatatattaaaaacagaattagcaaaagcagtagttgcatcaccactgctagtaccaccaggcttaacataatagcaaccgccacacataactatttcactcaaaacttgagcacattcattcgcaaggcgataaaatctatcaccatgtgaacaacaaaattcatgtttgcgggccaaaactaaactactaacaatacgcaaaatatttggcatagcacgatcacatttaggataatcccaacccataagaacagggttgtcaacatcctttataagatgacgtaacatatcgtcccaaccaccataaaatttagtggttcctataacaacaggaacacctcgggtagctgctatactcttcaaacatttttgatggaacattcggcctgtcatagtactaagaatagaaacacctgctacagtgcgagctctattcttagcactgatagcatattttaaattcatttgagttaaggtgggcagaacattacgtttagtatatgcataaatttcattctgttcctcaaatgataatgcctcataataaagtctggctttaccaaatttattaaatggataaccagcacttttatcataattattaacaataacttgtgatgctggtatacaaccaccatcataaatttcaaaatatttataaacaacttctaatacaaacaataactgcttaatatcaaccatagtaggtaaattatacttataataattataatcagtaattgcagcattaccatcttgagtaaagaaaaaatgtttcaaatcaactgtactaccctctttaaacaagcctttacttttaacaaactcgtaaaagtcttggttaaagttacctggttttacagtttgaaattttataccacttgtaatggcagctacactaaaacaacaagttcgtaaatcaagcagagcactagcagatgcaacgtgcatagcaggatctgctgcataaagaagtaaatctttaagagacaaacgataacggtgtgtgtcaacatctaagttcataactacacctaactctttgtaatggtaaccaatagaaacaacaaacggtacaccatctacaaaaatttgtctaacaaggggaccaaaacaagtattaggtaaaaccatactaaatagtatattaaaattagcacaatgaataatacacctatcattatcacaatccacagtattaggatgatacttcataccccaatacttaaaatacttattaaacaactctaacttgtaatcagtaaaatcatactgtacaagatcgaattgtctataactatcattaacaaataattcacaatctaatacatgacacatagtcaacataggcatcatataagaatagtaagaatctgcaactgccacaccaaaccctggggctgtttgtataaaatcaccaaaatcataccattgaccatacaaatcttggttatctaaagttaaaacaccaactaaacctacttcaactaaggtgtctgcaaaaatgacagtattaagtaaagctctattaaaaatagggcctaattttttatatatattaataatatcaggattttcaacaaaatcataccaatctttcttagaaaagtaggattctttacaatcagcatactcacaaagaatttcacacaatattgaacaatcattacgatcaaaatgacgcaatgcatagcaaagatctaacatagtatactttgaaagattcctacgaactatatgtggcacgcgactaccatcaatatcaaatgtaaagaaatcatgttcagccacaacaccacaacttttagtcaactcataataagttttctctttattataaacttctaaattagttcttttgacaacaaagaacttatccaatttattaccgtcgtcatctatacgctgaaaacggcaacaattcactttataatataaacctataccagctctattggtattacaaatgtcaaatgcccttaattgaacatcagtagataaaccactagcacagggtactagccgggcattcacactagtaccccgaacccgtttaaaaaatttaaatctttagattgaacagcgacacttgaacctacacaggaacaactgccatctctccaaaaaccacagacttgacaaacatcatgtgttaacacataaagaataggatcttttatacccaaagggacttgtacaaatttaccacgtaatttacatataccatctacatctggatgctctacacgtgcacggcaataaatacaaactgaggcaccaccataagaatcttggttaatagtagcctcaggtttaatagtaatggccataccagtaccagcatgatcacagagcattttaacacaattaattataggtacaccaccttgttgtatataatctaaataagttttcttaggatctacagaaaatgcacataatgaaagtatagaagaattagctgcatactcagtagcaacaccagcctgcaatctaattgttgaagataaagtaccaacaacccaccctctagctaaagtgttacatcctttaataaaataaagatacttaattttaagtcccttaacatcttgtatagaaaatttacaaggaggatcaagctctaaaacaacacaatttccatcatctttcattatcttagtatacttaagaccatcaacatcactaagaacagcataaactattctaccactactaccattattataataacattgagtaggaatattacaattcatatcagaaccactattaacaacttgtatttttaatttatgaggcatcaactcattattctgcataacagcattagcaacttcattatacctgttcgcaatgataacaagaggccaattagaatcaacactaatatcagttaactgtttattaataccatcagcatcttgaacagtctgtatatgccatacactaccagcatatgtaacataaacattatcaacaactttatcaaaaacttgtttatctggtattactatagttaaagtattagcagccaatgctggaatagcactcaaaggtacacaacctttaacagcattatccagaatagaatttaaagcctgattatccaatttacgaaccatgctaaaaagcattgtctgcaaagcggaaacaactttactcttcttatcattaatccgagcctctttatacatgttagtaagtgctaggtctgccatacgttcaagtttgcgagctacagctttatcacgttcatacacagacttagctatattacatgctttttctaactgttttatctgttgttgattaacagaaccactatttttagcatcagccaaatttttctttgcgacttcatattcaacaaaactagccatatttacaaactcactttgcaaagcctgcaaaacggtactatcttgaacataatcatcgctaacttcatctatacttgcaagacacttagtatcaactgcagcaggattggcgaataaaacaatcaataattgagcaagcttatcaaaagctacactcaaatctgaagtagatagtatttcattatgtaaaacactacaatactgccacaacttagaattagaagcaacatgcaaatgctgtaaacaatttaacaaaacaacattagcacatttcacatcagtcaattttgattgaatttgggagacttcaataactggcacgccacctattccaagcagttttaaatttaacaaaatagcctcaaaactattacgaggtggacgtaagccattagcattcatataacgcaattcttgaacagaaattttataattataaacacccataggcattctaaaaacactgtttaaaagagagaaaaatccccaataacaagataaaatataccctataaataagtaactcaagagaatcaatttaatataaggtacatctgtaaaataaaatatattaacagacaaccaattagcaacaatttttgctatagctaatgacaaaatagtggtccatgtataagtacctaaaaaggctgtaataaataacaaaacatcctcttctaaattcgacccaaaataccacatagaaattaaagtaactattctaccaaccaaaaacatcaaagaaaaaatgtcatgattaatactatgcatagttataaaaatagcaaaaacacataaaatacaaccataaaatacttcataaacataagtaaaattcacagcaggaacaaaatatgagagccagacataagtaaaacctctaaaaccttccttataaacaactaaataatttacataaaacaaggtacagagtacaggaattatatacatagtcaaataaaaatgcttatgtttaactagtaacatcataaaactaacaaaacaaagtacacataatgtaacaccaatcatatgtgtattaatatacataaatatagtccatttaacaaatgcagaaattatacaactaaacaaaaatgtagatatcaaaatccaataaattgtttctttaataaatctttttgttttagattgcaatttaacaccagccaattgttgataaacgtcagaaggtgccaattcatcttcaaaagtacaacttcctagtatttgacgaccttgaaatcccatatatagacgcttaatagcagccaataaagtttcaatagaaacacctgtcattgaagccaaagcatctaagacaagatctgcttttacttggctaaaaccatttgccatagcccaaacattaaaatcttcagtagaacaaacatcattttgtacaaaccaagcacaattattaagtatagctgcatagagccaagcaataacattaacagtctggacgtagtccttaactggcaactgtacaacttgagcatctctatatggaccataaaaattaccagtaaaatcagtgccagtgtgacaaccagtactgagctctaattgatgcatatatacaaacttaacactatcacctgttaatacataaccaacagatccacatgacccacacaaaaaagaacctttaatagtataactactacgcatagtaacatgaaatgccccttgtggtcggccattatacgcagctaaaacagtaaaagtttcaccaggtttaacattaccaaaagtatattttggagtgtaaggattttgtaaagagactgtcaaaacaagttgacagccctgcatctggtaagacacaactgttaaactcatccgaccagacattatagtaaaatcacctagagtaactctacacaataaggcagaataatcaggttcgttcatattagaggatgaacatataacatgacgaggacaataaactttgtcatctaaccataaaccattcaaagtcatactaccataagtaacactaacaatacaaggttcaatttttgacgtaggagataccatctttacaatacctgattgcaaaaaagatgtagaaacagatgctgtaggaggttggtataagacatcattaccattattgtgattaaatgtttccatagctttagctaactgagaacacgccgcttctctataggcagcagtatccattttaccactatagtaacgatacttattatacaaactcaaatatctattgtaggcaacatcagaaacagaattctttaatctacaataagaatctttagtaatcataaaagtagtaagagatgtttcttcaaatgtactatcactacatacattaacaccaattttcctacaatatgaaaataaccataaaacatggtttgcaataaccatagctacatatgtgacacaaaaccaaaaaggcattatagcaccatacataacaatccattgcaaatgcataattacactaatttcagaaggaaaatacaatgttacataaaaataaaaacaagcataaacacatgcacaaataggataaacttgaaaaacaaaaagcataagaaaattaatacaccaaacaacaacatttataactacaacactagtataatctccaaaagcacgcttaagttttattaaataataaaaaaccaagacaacaactatagccaatatagctccaaaaatagaactagcagtaagagaaaagaaatctataggacgaattaaactactaaaaaattgataaaacaaatcaaaaagatctctaccacaaaaagttccaggcatacttctataataatcattattcaaaacccaggaactattaaaattaaaacatataccctcttcggcgtattcacatgcacccactctacaataagtcatagagcgcgttcttacaatacgtacaataccttcactaataacatcaggaaatcttataaaaccattagaattagcaaggctataacgtgtatgtggaaccaaagatgtatacaaagaagcattcttcataacaccatctgaataacaataaggatgtggtgtaccatcacctcttttaaacatagtacacaaagatgataaaacacaaccactagcataaaaatcattataagaaatctgaatatgtggtgtatagcactgaacactatcactagcaaatgcataagttaaaaaatgtaaaacatgaaagccatgtctcaaaactttagtaggaacattaaacatagtagaaccgatatcttcatccataactgccactacaatagggcaatccatagaattatgatagtaaacagacccaaaagtggactcataccattgatcaaattggaaaaatttattagcaaaacataaatcattaactgaaatatctctaacaacaccattatcaataactttaaaactagcataagcaggcaaatgaatatcagacttataaacactatatgtaggcaataaagcccacaataatataaaacagattaaactaacaaaaaataatatatataacaaattactcaatacaacacctcctttaagtgaaaagggtgttgtaagaatagggacacttgcctcttgcttattaaaagtcaattttaacttcaagccagttttaacacatgctttttttaatttatgctgtaaatcagcagtaagttgattaaaagcatcaataaaccatatacaagaaatattagctgccttagcaacattaccctgtacatgcttagcaccattctgtataagaacacctaaatcagcagctacaatattatcactctttaaatatgtaggtaccaaattgttataattttcatcagtaaattccaaaccagcagctactgcagatatcatagatttagtaataaatcttgtttcaacatctgaatcaatggaacaacatttacgtacacatcccacaaaagtatctaaaaccttttctaattgcacaccctctctaagagaagcatgagcaatgttaacaaaattattaaaactctttctatcaacatcaaaatgagacataaaagtatcaacataaacatcaaacatagtctgggttacagagataccattacaagctgtagtaattaactttttgtctacaagtaatataggcctatacaatgattgtgcataaaacacaacagcattcagaaaattagctctatcagcatcactctctactacaactacatacaaattaggaacaactttaactttagaatgtaacagattattaatatctacaaataaactagcatcaacatcatcgtaaacacgctgtccatctctatcatagaacaaacgcatcatacaaccaacttgcttaatatcagtaactacataatgtgaagcatcagttggatttacaggtcgtttaagctctttagaaagttctatagcagcttctacagttataaaagtgttacctggtttaaaagaatggcaattaaaacaattccattgatgtttaacacaaaaaccagtaccaccattagcagtaatatcataataacgaattacaccaccaacaatagtactacacttaacacgaacactacaatttcgtttataacaaaataaacaaccagctttattacaaccatagacaatatgcctaataaaaccaactactttatacatagcagtaacaactatataaaaccgcaacaagacaaaagcaggtaacatattagctacaaatacaataaatctaatcaaccaatgcatagtttctaacataaacaaatcaggcaaccatgtagtaaataattgtaaaccaataagacaaaataatggataaaaccatactgtgtataatgaataaccaataacgagttcaacaattaatttgactaaactaacataatcaaataaaacacgtctatctacttcatactgaacaaaatctatagctgcatatgtatccaacatatcaaaaccagaatgacacaattcacatataaaactaccattacaaaaatgacttgtaaaacctacacctaacttagaataaaaatcacaaattgtaaccaaaccaaaagtagcctttatccacataacaattcttcccacaaaaataggaaaaacactaatattaggaagataaaagtcactaaaaataacatttatatacaaaaaattaaaccaaaacaaaaacacagtggctacaacaagaaaaccttttataaatatactccatctaaatgtctgaaaagcatttttaagagccaaacaaaacaaattaaaagtaaacttagaagctatttctgtagtataaaaaatggttttatcatttgtaaaatgtaataaactaaaaacataaataaacaaccacttcaaaaaaccataaaattctatagctcttgctttaaaaattttaggaactaaaagagtttgattatcatctcttaaacataacaaatctataggtatagtaataggtttaataccatatcgtatatattccctaactgttggtgatttaactaggcgtgacaattcattagcaacccaaacaacataatcacaacctgtcaaatacatatcccaaacatcaactaaagataaacttttaacaaccttaatagaactattttcatcattaacaataatagcatcttctattttaacagtctttctaacaccctttaacttaacctctttagtactaatctgcgattccataacagaagtaaccacattaccttgtgactcctcagatacagaatcaacagacaaaacactatatctattttcagatttaaaactaggtttattaaaataagtaagagaattcaatgatgcttcatcatgacaaaaccaaataacaggcttaccaaaagtttcacatcctttaaaataacgtttcacatataaatcatcagatgccaaaacaacatcaccagtagctacaggccagactgttactttgtactcaacaaacggcaaatctacattaaaacctaacttatcattcaattgagcacaaatatcatgtccaactaacttaaagttagtataaacaccgtcaactttagcaaatggtttaaactgagcctttataataggttttgtataatacttaccattatcacaataatattgtgaaagatcagggttataagcaaccatttcaacatcatccaaaaaataattagtcaacatagatgtaaaagtctgggttaaatttttaagatacaagcagtcagttaaacaaccactaacacctgtatattttttaacactacaagcatcataatgttggtaaggtgaaccacatttcaaatgtgtataatggcctacacctacacccataaacatgttagctgcaacaacatcatcaggtaaatccttactcagaggagtattagaacaaatcaaaaatggtacattcaatttagtacaatggacaattctacctgcacaattacagccaatcttataaccattaaaaagatcagtctttgctaatgtaccaaaatgcataacagcatcaacaccaacacgactttcttgtttaataccacaatcacaaataagttctaattcacaaattgcacctgataaatcagcttgtttcaaaacaacacgaataaaatcagtagcatctgatggttcatcaaatttaaaatgacctttagctaaaacaagagcaactaacctatgtggtctgccagcacgaaattcataccatgcttcctgccactgccatttattaaatttaagattaatatgctgcaacataagacaagctacattcacataacaattattatgagactgttcaaaagaaaaaaatggaccgttaacaactacagaccatttacatactgttaaaaaattataataagcaagcaattgttgctgatcaaacccaaatgaactttgtacagcagaaatatcagctaaagacaaattttcatactgatataaaattttatcggcataaaaatcactacactttaacttagtaacatcaatgccatcacagaaaacattaccaagtattttaccaaaaacttcacctacagtaagagaaatagatttaaaattaacaccatctacagtaagcaaaacatctatcttcttagctaataaaacacaaacttgattaacagttgctttataaaaagaaccatcacatacataaccaaagtctttaccctgactacatatataaatagaattaggacactcaaaatacttaacagttttaacaccgttaataacatcaaatttattgataagacgccaatctttaggaagactagtcatcttagacaacaaataatcacgaacgtcattattcaattgtatatcatgacgaagcaataaaacttcttgtataacagaagaatttgaaacaaaacaatcatcaccactcaaaaaaagtttgtatgcatctgtctcaaatttaataacacggcctacattagcagttaatctaacagccaatgctttagtaccaacaactgaagtaatttgacatttttgaataatatcaaaatcttctttattattactaacaaggataacttgtttatcaacaacacctagaaggtaagttaatgacacatcagcaggaacactaaatataccagccgatatgagagtagacaaacaacaatcataattattaagatgcttataagcacgtgctaacaaaacataagattgtcttccatcttgtctagcatcagggcctacaatattaagaattgttttacataatttaccaccggtagaaacataacaatctcctacttggcaaacacctttagatttaaccatagcagcagtttctttagaaaattttttacctgcagctacagctatagcttttgcaactccaccaccatggagcatatgcccattagcaggattaacaataacatcagctttaacaagtctagcaacatttataatatcacctttaacaaaacatacattaggtgttatacacaaaccatacaattgaggtaactcaaaagaagacatactaaatgacattccataacctactataaaatcaaatttatcaccactaaatttagtaacaaacttaccatctatttgttcatcacctataacagctacagaatgacaaacgtttacatccacagcacatgcagcaataaaaatttttttaggggtgcaaaaagcacaaaaattgtcatcaaataatgaaaaatgtaatgtacaaggtaagtccgctgctattagagtcatattatgtccacacttacaaacatgagacacaatatctccataaaaaaacaaagcatccaaaccatttaaatcaaaagaaaaaccacattttaaacaacaccaattagcatacgcattaatatcaaactggtttaaaaaccaataagcaaaatcagctacaaaaccaccttgaggcaaaacaatagctttaggaatagtggtcagtaaataatcaacaaaactttgattataacccaccttataagataaccacatattttcaatagctaaatccttaaacttaaaaggtaatttctgcattacaagtaacacagaacgcaaccaacaattagtatgtgtaatagtaggtgaccataaaccattaactttaaaatatgtttctgtttcaacactagaaccataactaacaaacaaagcatcattatagacatcattaaaaactaaaagagctttataagtatcaaagtcataaatactttcaatatcatctacatcatcaccagtaacaacaatttggtcatcattgtcaccagtaacaatctcttcatcgttattgtcaccagtaacaacatcttcatcgtcattgtcaccagtaacaacatcttcatcgtcattgtcaccagtaacaacatcttcatcgtcattgtcaccagtaacaacatcttcatcgtcattgtcaccagtaacaacatcttcatcgtcattgtcaccagtaacaacatcttcatcgtcattgtcaccagtaacaacatcttcatcgtcattgtcaccagtaacaacatcttcatcgtcattgtcaccagtaacaacatcttcatcgtcattgtcaccagtaacaacatcttcatcgtcattgtcaccagtaacaacatcttcatcgtcattgtcaccagtaacaacatcttcatcgtcattgtcaccagtaacaacatcttcatcgtcattgtcaccagtaacaacatcttcatcgtcattaatagtgtcttcaacgacaccatcaatagtatcttcgacagcttcactactgataacgtcttcaacatcctcaatagcaaaagtacaatacatacgagaggccattgcttcatcaccagcctcatcaaataaataaacaacattctcattaagtttatttaaaaatgcacgaacttgataaccaaccactggatgctctttacaagagtttaaagcattctctatagcatcacaaacaacagcaacaaaatcatctacagtaacacccttttctacttcaaattctgaacaaactttacctaaaatatcatcaaaagtagaatctaaatcaaacataaccttaactgtcatcaaagacggaatctccataacaacaggtttctcgttaaaattaacttttctacctgcacatggaaaacgccaagcctgatctaaaagacaaatatttttatcattcatgacaatagggaaaaatttatcaccacacttacccatgtacatattatctataatacaaattttttctacagatttaggtggttgacaatactcataagatgataaagaagatttgacattctcaataacatcatcttctactataacagattctgcaacgccttcaaaaaaataaatttgttgttcctgtgcattacatggtaaaacaaaaccaggaattaaccctgtactaacgttataaaacttattgcctacaatacaaactaaaccattaatagttttaagaacaggcatatcttttaaaacatcaactgtaacacactctaataataacttaaaaaaagtgtaaaatttattaactaaaattttagcataatcaggtattaaagcaacaaaattaaagttggcttgagatactacaaaaagaccattcaataattggtaaagaagccagcctgtagcaggtgcactagcatctaacatggtattaaaccaattaaccattttattaacaagtgtagtacccaataacttaaattgagtaaccaacctattaacataatgctctatataaaatgtagcaactgaaactctgtccataaacaaaatacacatttttaaacacatatcagaaacttcttgtgaaaattgagacatcaaagatgtaaagaaaataccactctgaattagataataactacggggaattaaaccatctagtaaaaaaggtacaaaaccatctccacaaactgcaaacttgcaagcaaaatcagcacgacgcttaacaaacaagtcaatattttttagaagcatattataatcacctctattaagcaacagttgcctacaccaagaattattaacgccaagaatatgattttgttcaagattaccacacttacattgaacataatctaagtaaagtgcatgagtaataagagcagtttctttaacaatagatttacaacctactacacctgaataaaccaaatcatcataagacttgactgaagatttaattataggaatccacaatccaggacgcggcgaccaatatatacaagaaccaaatggtgtgacagaataaccatacaaattaaaagaatcatggttaacagtatcagtactattagtaaataacacaggattttcaggaataacaccagatgattgggctttaacttcgctagagtcataaactgtacaacacaatggacaagaaaaaccatccatcatattacctgaaacccaaccataaaaatcacaattatcattaaaacaatctacataaccatactgcataacaaaaccacaatcacacaaatcaacattatatatagatttaatagaaaaatcatccatatgagtcataactttcatcaaactaggaagctttaaaactattgcatcagcagataataaatgtacaggttcacgtataactacatctccatctactacatcttctgtaggttgtgcaacatatttaataccacaaatagtagctatagtctgcaggcgcataacaaatcgtgaatcacgaactacatgccaagccactacaatatcaaagtcacaattggcaagccatacagactgcttttgtctcatatcttgcaaagaataatgaccataagcttgaagacaatctgctaatttaccagaatagtcacaaccatactggtctacaaaaagtacgggtttaataccacgatattgtctaagtaaagcataagctttttgtgaatatttacctttaggctcagcatgaacctcagcataagcatcttctacactaaaatcataatcatcaaatttaaaatttgaaattattaaatcactctcttcaatatacaacctacagaattgaaaccatttgtgaacataagatggcataaaaccaaaaggtacaatccaacccaaaaaatcttcaccaaaattagtagtagatgtagtcatagaaagatgatgtacaacataacgtttagtcttgtatgaacggaacaagcccataacataccctttaggaaaaccacccaagctatgcaaaggtgatttaattaaaattgccgtaccggactttacggctgttttagttagaacttctacaacatgtagatcttcatgaacaaaaatatcacggataagatttgactgcacatgccattcttgtccaagaatgcagcgacaatctatcttcacatgattatcataaacgaatccaacactttccatcgcttgaccagtagaggggcataacccaccctcatctgacttcataggactagccaactcctccgctgcatccggaagcagccaacgaaattctggcgcccacttgaagccgagaccgtatttgctggttttaatcattgcgacctatgggagggacgctgaggacaaccaacacgtcactggcagagagatgaaaagtgtggaaagtaaaatacaagattatgattaaaccacactcacaagcatggataacagggaatcttgtttaaaaagtttagatttaatgagatctgacaagagatcgtaagctgatagacggtacggacgcaattcgctcttattc

SEQ ID NO: 1320 - protein, 12 aa, Corononavirus-HKU1
FFFFFCNSSKRL

SEQ ID NO: 1321 - protein, 6 aa, Corononavirus-HKU1
LISIIY

SEQ ID NO: 1322 - protein, 33 aa, Corononavirus-HKU1
TLQLIALPGGVYTTAKPYNYSNNQMSKYKISTN

SEQ ID NO: 1323 - protein, 36 aa, Corononavirus-HKU1
YIVCNNLLYLLLQQEFILIESVLFRIIARGYHLVSN

SEQ ID NO: 1324 - protein, 19 aa, Corononavirus-HKU1
DSFSLSNRVFYIRIIKSSK

SEQ ID NO: 1325 - protein, 9 aa, Corononavirus-HKU1
TMILRSKII

SEQ ID NO: 1326 - protein, 7 aa, Corononavirus-HKU1
NVLSTST

SEQ ID NO: 1327 - protein, 8 aa, Corononavirus-HKU1
IKRVKLFW

SEQ ID NO: 1328 - protein, 27 aa, Corononavirus-HKU1
LFNTSFTLRFRTQRIRISVLIRINVSI

SEQ ID NO: 1329 - protein, 13 aa, Corononavirus-HKU1
ILFKNFHNCLKAW

SEQ ID NO: 1330 - protein, 19 aa, Corononavirus-HKU1
STIKPNRTRIMKFKNIFNR

SEQ ID NO: 1331 - protein, 10 aa, Corononavirus-HKU1
VSLGISFNQV

SEQ ID NO: 1332 - protein, 12 aa, Corononavirus-HKU1
FRTKEKSTWCRS

SEQ ID NO: 1333 - protein, 14 aa, Corononavirus-HKU1
FCKNRKLRIISTKL

SEQ ID NO: 1334 - protein, 33 aa, Corononavirus-HKU1
HFSITKILRRSSFTKTLLNITMFIRSSLLARFC

SEQ ID NO: 1335 - protein, 24 aa, Corononavirus-HKU1
NFMPDFLGILLSDLLRFRIFTKLG

SEQ ID NO: 1336 - protein, 16 aa, Corononavirus-HKU1
NKISDLISHIRFYYRI

SEQ ID NO: 1337 - protein, 9 aa, Corononavirus-HKU1
MSKIRITST

SEQ ID NO: 1338 - protein, 6 aa, Corononavirus-HKU1
TIIGST

SEQ ID NO: 1339 - protein, 10 aa, Corononavirus-HKU1
TWSTIRSRPS

SEQ ID NO: 1340 - protein, 27 aa, Corononavirus-HKU1
AFNIIALRQNRTRRKPSRDSFLSSRIP

SEQ ID NO: 1341 - protein, 42 aa, Corononavirus-HKU1
RNIGGSRSVSLVISNPEDPFEGFTIGCIGIWAGTEIVEIPSR

SEQ ID NO: 1342 - protein, 38 aa, Corononavirus-HKU1
QLLLLTISCFKRTPAVSIPISFCFRRGYSESNGNSLTI

SEQ ID NO: 1343 - protein, 60 aa, Corononavirus-HKU1
KFKVSTFLKLSDPGEPGIMWDSISLWLSRHSEFRLGFSASIKGLVISLRLVSPRSFLEDS

SEQ ID NO: 1344 - protein, 26 aa, Corononavirus-HKU1
TISRGASTSSIMTGSIRHPNSLDLSS

SEQ ID NO: 1345 - protein, 12 aa, Corononavirus-HKU1
QGSIHTTRFTRR

SEQ ID NO: 1346 - protein, 18 aa, Corononavirus-HKU1
TIVTNFRLNKNSKTTINI

SEQ ID NO: 1347 - protein, 21 aa, Corononavirus-HKU1
KGTFIGTKYLHLSYSNIYGQI

SEQ ID NO: 1348 - protein, 22 aa, Corononavirus-HKU1
KSITSAKFDTLYIKMTTNNSSS

SEQ ID NO: 1349 - protein, 111 aa, Corononavirus-HKU1
CVIVLNNWPNKHLAFHINTHKIIGLWIKTPPTASSNKKPNTINKIKNPYNNRNNSKHYRKCKKSIIQSIKTIKYSQGDSQWPHKPKNNHLDKINKHTTARITELQYDSNKK

SEQ ID NO: 1350 - protein, 10 aa, Corononavirus-HKU1
YYTQREIPFF

SEQ ID NO: 1351 - protein, 19 aa, Corononavirus-HKU1
ECNSLIRSKLRKKRFIHNV

SEQ ID NO: 1352 - protein, 10 aa, Corononavirus-HKU1
SEVGGITCSL

SEQ ID NO: 1353 - protein, 9 aa, Corononavirus-HKU1
DLYNCIPLL

SEQ ID NO: 1354 - protein, 70 aa, Corononavirus-HKU1
AEGEIIKKLQKPQSCIQSLIVAKKATTKIKEIRQNKTKTKICPMYQAVSLKNKSTILIKCLCTPNNKFRS

SEQ ID NO: 1355 - protein, 30 aa, Corononavirus-HKU1
SRHSLRNSITISSKTSYNTKIITMGNIVTT

SEQ ID NO: 1356 - protein, 15 aa, Corononavirus-HKU1
CKVRSKFAKLATPNI

SEQ ID NO: 1357 - protein, 15 aa, Corononavirus-HKU1
RYNTVTNNRLTVIIL

SEQ ID NO: 1358 - protein, 27 aa, Corononavirus-HKU1
TQIFKVCNTKFSNNKRMCVARSPNVHK

SEQ ID NO: 1359 - protein, 11 aa, Corononavirus-HKU1
SLDLMRSDKRF

SEQ ID NO: 1360 - protein, 7 aa, Corononavirus-HKU1
DVLITKS

SEQ ID NO: 1361 - protein, 8 aa, Corononavirus-HKU1
PPYSSQQL

SEQ ID NO: 1362 - protein, 51 aa, Corononavirus-HKU1
HLLKHAEPQPVQQHIKKSNTRNIINEKEISSQTYQGHFTYISYVPISLRLI

SEQ ID NO: 1363 - protein, 9 aa, Corononavirus-HKU1
LLFKDLIDS

SEQ ID NO: 1364 - protein, 5 aa, Corononavirus-HKU1
IRFIS

SEQ ID NO: 1365 - protein, 10 aa, Corononavirus-HKU1
YKSKKVALIV

SEQ ID NO: 1366 - protein, 11 aa, Corononavirus-HKU1
RFKVKLGAMDV

SEQ ID NO: 1367 - protein, 4 aa, Corononavirus-HKU1
FLNQ

SEQ ID NO: 1368 - protein, 13 aa, Corononavirus-HKU1
DNSDSKSDNFGTE

SEQ ID NO: 1369 - protein, 25 aa, Corononavirus-HKU1
TRGALVKLTEQVFIKTTFLSEIGSG

SEQ ID NO: 1370 - protein, 7 aa, Corononavirus-HKU1
ELPVNIQ

SEQ ID NO: 1371 - protein, 34 aa, Corononavirus-HKU1
SLCLIKYPCLGAIPTSPDIHKPGLTKTVLKEIGL

SEQ ID NO: 1372 - protein, 8 aa, Corononavirus-HKU1
LKCINNKP

SEQ ID NO: 1373 - protein, 5 aa, Corononavirus-HKU1
TNDKI

SEQ ID NO: 1374 - protein, 11 aa, Corononavirus-HKU1
LPLPQKLIRGD

SEQ ID NO: 1375 - protein, 25 aa, Corononavirus-HKU1
LLTHSLTFSIAKAAPNFTREISLSC

SEQ ID NO: 1376 - protein, 14 aa, Corononavirus-HKU1
AFKAVKRPLISLSI

SEQ ID NO: 1377 - protein, 32 aa, Corononavirus-HKU1
ASKASRRDKISCKEELIAPNLLNNCCNKLLSA

SEQ ID NO: 1378 - protein, 21 aa, Corononavirus-HKU1
ALELTTLCILASAELVALKPF

SEQ ID NO: 1379 - protein, 14 aa, Corononavirus-HKU1
IERRALLKAVAINF

SEQ ID NO: 1380 - protein, 42 aa, Corononavirus-HKU1
FLLRTSIVTPKPLILYCTLRENGMPAAADHGGNIAATVAAVV

SEQ ID NO: 1381 - protein, 31 aa, Corononavirus-HKU1
DSDKIGGKTLIPLKDCTQRRSLISLPPVQLL

SEQ ID NO: 1382 - protein, 67 aa, Corononavirus-HKU1
ASTKPTSESLTLSNNKSSKKEREEEPQCGPKHPTRDLKLILSTSKCKLVLRLELSVTPCIRVSATCN

SEQ ID NO: 1383 - protein, 31 aa, Corononavirus-HKU1
VVSSKPLTSSKILLILSQKVPYSDNKSWQAA

SEQ ID NO: 1384 - protein, 17 aa, Corononavirus-HKU1
LEQTNKEQSIVTLGELV

SEQ ID NO: 1385 - protein, 4 aa, Corononavirus-HKU1
INSS

SEQ ID NO: 1386 - protein, 12 aa, Corononavirus-HKU1
PTIVKLVGILIS

SEQ ID NO: 1387 - protein, 23 aa, Corononavirus-HKU1
RPPTDSILSLTKLTLKGSKVTKR

SEQ ID NO: 1388 - protein, 18 aa, Corononavirus-HKU1
EAEILLRLRREEEEEGEL

SEQ ID NO: 1389 - protein, 16 aa, Corononavirus-HKU1
STQKPLPMRRAQEETE

SEQ ID NO: 1390 - protein, 12 aa, Corononavirus-HKU1
SVKLSALKTQPR

SEQ ID NO: 1391 - protein, 5 aa, Corononavirus-HKU1
LSKYG

SEQ ID NO: 1392 - protein, 9 aa, Corononavirus-HKU1
VVKEILFKT

SEQ ID NO: 1393 - protein, 6 aa, Corononavirus-HKU1
LHFKLR

SEQ ID NO: 1394 - protein, 8 aa, Corononavirus-HKU1
SKAKEEAF

SEQ ID NO: 1395 - protein, 8 aa, Corononavirus-HKU1
KAAETLPA

SEQ ID NO: 1396 - protein, 31 aa, Corononavirus-HKU1
QGKILYVLLVTKSLKPIMLPLESYKRFCQLL

SEQ ID NO: 1397 - protein, 14 aa, Corononavirus-HKU1
TAETSLKIPCPVIP

SEQ ID NO: 1398 - protein, 44 aa, Corononavirus-HKU1
STQTSVKTSVLGCNKSLEQVVPLLIPFKIKLEKILQRLLLTQVS

SEQ ID NO: 1399 - protein, 43 aa, Corononavirus-HKU1
DQPRKASVLQRQETLYDPSNTPHFSSSTPNPAQCSPTPTRDFF

SEQ ID NO: 1400 - protein, 6 aa, Corononavirus-HKU1
EQDLGS

SEQ ID NO: 1401 - protein, 26 aa, Corononavirus-HKU1
AVIGSGKQEHLHQSVWSSTVVLSQER

SEQ ID NO: 1402 - protein, 12 aa, Corononavirus-HKU1
LVPIGQEAEGGL

SEQ ID NO: 1403 - protein, 22 aa, Corononavirus-HKU1
LLQLEAKEGLAQGQKVLLTEKQ

SEQ ID NO: 1404 - protein, 18 aa, Corononavirus-HKU1
ELKLKLLKPYLLFQEEGL

SEQ ID NO: 1405 - protein, 11 aa, Corononavirus-HKU1
LLIVTLIAGKL

SEQ ID NO: 1406 - protein, 9 aa, Corononavirus-HKU1
QELEVVSIL

SEQ ID NO: 1407 - protein, 49 aa, Corononavirus-HKU1
LEDCRKPELPNCKSDRLELGMANLSKTILLKQLPYILDSSKLLQEKESV

SEQ ID NO: 1408 - protein, 59 aa, Corononavirus-HKU1
TKRSKVLKLKLQLEKILRSQLRGEGTLKLLSHLSMSQSGKSGIRRCTVATGLTVKPDKS

SEQ ID NO: 1409 - protein, 12 aa, Corononavirus-HKU1
TPVLGNKDLVLH

SEQ ID NO: 1410 - protein, 54 aa, Corononavirus-HKU1
ISLKKLLEQSTALVITPRLSNLRRYWRLDKGVTQYCKVSLSVLEDIALQVKGKT

SEQ ID NO: 1411 - protein, 20 aa, Corononavirus-HKU1
DKRVPRYKLNKKVVGMPESA

SEQ ID NO: 1412 - protein, 5 aa, Corononavirus-HKU1
KVPRS

SEQ ID NO: 1413 - protein, 9 aa, Corononavirus-HKU1
KYNQSVETL

SEQ ID NO: 1414 - protein, 30 aa, Corononavirus-HKU1
VKFFLNRHKGSDLSKCQDSLRELPLDLQIV

SEQ ID NO: 1415 - protein, 7 aa, Corononavirus-HKU1
GYSHIVY

SEQ ID NO: 1416 - protein, 9 aa, Corononavirus-HKU1
QAVISKTPL

SEQ ID NO: 1417 - protein, 4 aa, Corononavirus-HKU1
TTIV

SEQ ID NO: 1418 - protein, 43 aa, Corononavirus-HKU1
ELLIKTLPITIVLNSLYKVLLTYNLVFLTLEKIPLLKSDKKGF

SEQ ID NO: 1419 - protein, 24 aa, Corononavirus-HKU1
YQRVLKYVVPFKDRSLKLAPDLGK

SEQ ID NO: 1420 - protein, 9 aa, Corononavirus-HKU1
PVNNIVVFK

SEQ ID NO: 1421 - protein, 5 aa, Corononavirus-HKU1
TRSSI

SEQ ID NO: 1422 - protein, 5 aa, Corononavirus-HKU1
YVPKP

SEQ ID NO: 1423 - protein, 73 aa, Corononavirus-HKU1
ETSTTYSLMRGTVVFKSLIAKLVQLKSPITANVVGKIKIINNMFRFNEIYRYITKIIEKQQKVKLNIIKYLVK

SEQ ID NO: 1424 - protein, 10 aa, Corononavirus-HKU1
AKNHKHKLDV

SEQ ID NO: 1425 - protein, 12 aa, Corononavirus-HKU1
DTYQKNNRAKWM

SEQ ID NO: 1426 - protein, 22 aa, Corononavirus-HKU1
NYHIKIHHNMKYKKHYIKDQIK

SEQ ID NO: 1427 - protein, 6 aa, Corononavirus-HKU1
NHYHRG

SEQ ID NO: 1428 - protein, 7 aa, Corononavirus-HKU1
YHTCQHN

SEQ ID NO: 1429 - protein, 27 aa, Corononavirus-HKU1
QKNCENNNMAIDMQQIKKYLRHARCSI

SEQ ID NO: 1430 - protein, 10 aa, Corononavirus-HKU1
NQQPVQVQIV

SEQ ID NO: 1431 - protein, 7 aa, Corononavirus-HKU1
IYQNREL

SEQ ID NO: 1432 - protein, 16 aa, Corononavirus-HKU1
VRIKKVQWWKLYKNLV

SEQ ID NO: 1433 - protein, 13 aa, Corononavirus-HKU1
EKYKYSLNQDKQH

SEQ ID NO: 1434 - protein, 15 aa, Corononavirus-HKU1
KNHKQSQYLCYNSTD

SEQ ID NO: 1435 - protein, 14 aa, Corononavirus-HKU1
KGKAVLNKENNLIK

SEQ ID NO: 1436 - protein, 4 aa, Corononavirus-HKU1
NKLP

SEQ ID NO: 1437 - protein, 9 aa, Corononavirus-HKU1
VIKYHFYKN

SEQ ID NO: 1438 - protein, 11 aa, Corononavirus-HKU1
KEKHYKEYQQK

SEQ ID NO: 1439 - protein, 7 aa, Corononavirus-HKU1
DNEKRPY

SEQ ID NO: 1440 - protein, 10 aa, Corononavirus-HKU1
NIRHDKILPC

SEQ ID NO: 1441 - protein, 8 aa, Corononavirus-HKU1
EAIHHYYH

SEQ ID NO: 1442 - protein, 5 aa, Corononavirus-HKU1
IYDKD

SEQ ID NO: 1443 - protein, 5 aa, Corononavirus-HKU1
HPHKK

SEQ ID NO: 1444 - protein, 12 aa, Corononavirus-HKU1
FDHLRQCNYKIE

SEQ ID NO: 1445 - protein, 4 aa, Corononavirus-HKU1
NENS

SEQ ID NO: 1446 - protein, 4 aa, Corononavirus-HKU1
NHRH

SEQ ID NO: 1447 - protein, 9 aa, Corononavirus-HKU1
MKSYHCCTN

SEQ ID NO: 1448 - protein, 9 aa, Corononavirus-HKU1
GEYPNNQNF

SEQ ID NO: 1449 - protein, 4 aa, Corononavirus-HKU1
FLNY

SEQ ID NO: 1450 - protein, 22 aa, Corononavirus-HKU1
YGYNQNDYHQIKTSHGLNETQH

SEQ ID NO: 1451 - protein, 10 aa, Corononavirus-HKU1
NHNRNKKIKK

SEQ ID NO: 1452 - protein, 6 aa, Corononavirus-HKU1
FRFNEI

SEQ ID NO: 1453 - protein, 27 aa, Corononavirus-HKU1
QVFTRLSPTKISLRVSRTNNLPLSIRE

SEQ ID NO: 1454 - protein, 5 aa, Corononavirus-HKU1
TKSFN

SEQ ID NO: 1455 - protein, 23 aa, Corononavirus-HKU1
SGLKLTTAVPANFKENLVISNKL

SEQ ID NO: 1456 - protein, 13 aa, Corononavirus-HKU1
APPFHVVLFLQNK

SEQ ID NO: 1457 - protein, 16 aa, Corononavirus-HKU1
LACITLPSISKEDLPR

SEQ ID NO: 1458 - protein, 55 aa, Corononavirus-HKU1
FIPIKNPSLEEAFTLVQKTVQNAKQLINLYKSAFQENSVIFIATLPPKDNLSRIK

SEQ ID NO: 1459 - protein, 9 aa, Corononavirus-HKU1
VKNPSLLTL

SEQ ID NO: 1460 - protein, 18 aa, Corononavirus-HKU1
SPIFLVRGSYISDIIKSQ

SEQ ID NO: 1461 - protein, 11 aa, Corononavirus-HKU1
QSNGKVIQSPK

SEQ ID NO: 1462 - protein, 58 aa, Corononavirus-HKU1
VTKLSLTNGFKSLSTRILPDGNHCLKTAEPGATSLSDPAPKCKTRILTGTANVVVFKY

SEQ ID NO: 1463 - protein, 18 aa, Corononavirus-HKU1
VYLATFIIQPVGKLIGLP

SEQ ID NO: 1464 - protein, 20 aa, Corononavirus-HKU1
FHKETLSNGTFKYLYKTGIE

SEQ ID NO: 1465 - protein, 12 aa, Corononavirus-HKU1
PGFQSLVACILG

SEQ ID NO: 1466 - protein, 13 aa, Corononavirus-HKU1
KVIILLSLHHNIN

SEQ ID NO: 1467 - protein, 44 aa, Corononavirus-HKU1
KSLKSTLILTTLLTQLKFNDLTIETKSSNNKSITVQTLLLLPHS

SEQ ID NO: 1468 - protein, 6 aa, Corononavirus-HKU1
SVIKYE

SEQ ID NO: 1469 - protein, 9 aa, Corononavirus-HKU1
ILESYCKNS

SEQ ID NO: 1470 - protein, 28 aa, Corononavirus-HKU1
INKLDFFFLRNKPISKCKPPITLWLKLP

SEQ ID NO: 1471 - protein, 33 aa, Corononavirus-HKU1
SSKPYLAINRLSSISIKSRSKSERGSKLDNTRL

SEQ ID NO: 1472 - protein, 28 aa, Corononavirus-HKU1
VKIVKRVRASLPMTLPAQLPPRLPCGLQ

SEQ ID NO: 1473 - protein, 95 aa, Corononavirus-HKU1
WLEHRLSVRLKITSSPSFLIANQNSTLSSPTLSTITPFKSARCGPLIIDNLLNFSVLIKTPFLAFLKASKAPVSRPSKSIFKFSMNFKSVYLQTP

SEQ ID NO: 1474 - protein, 10 aa, Corononavirus-HKU1
VELQNKLSLT

SEQ ID NO: 1475 - protein, 72 aa, Corononavirus-HKU1
SHRTCFQQISMFKFLRILSSGWCRILRFVNNSTAILVGNDVLFLKITVSTLLILTTTLSFIIAQGNSPVRPS

SEQ ID NO: 1476 - protein, 23 aa, Corononavirus-HKU1
PTLTKLYITFSKLCNVVKVFHKL

SEQ ID NO: 1477 - protein, 5 aa, Corononavirus-HKU1
KSKFL

SEQ ID NO: 1478 - protein, 12 aa, Corononavirus-HKU1
TQKVKPAVVTIL

SEQ ID NO: 1479 - protein, 28 aa, Corononavirus-HKU1
LQYSSACFEQTAPPRLHRVIQVALLKGT

SEQ ID NO: 1480 - protein, 17 aa, Corononavirus-HKU1
STCLDSKPSTYTQGVSE

SEQ ID NO: 1481 - protein, 75 aa, Corononavirus-HKU1
KKGIGLRFSKTVLVKGLVWNACLLTYKLPPLHPGRFNLFNTRVSNLQTIELDGYLSTLQFQNIHKPSLKLSLCTS

SEQ ID NO: 1482 - protein, 13 aa, Corononavirus-HKU1
NNCLTDLATGKAS

SEQ ID NO: 1483 - protein, 4 aa, Corononavirus-HKU1
NLNS

SEQ ID NO: 1484 - protein, 13 aa, Corononavirus-HKU1
SLTQAKPLGLPMS

SEQ ID NO: 1485 - protein, 46 aa, Corononavirus-HKU1
HKLYLLHSMAALSMTRCNNLQDVFILTSLEIIGYSKFQLTDLQKQS

SEQ ID NO: 1486 - protein, 25 aa, Corononavirus-HKU1
IAKQRVIIASADATCAPLCTLQIIS

SEQ ID NO: 1487 - protein, 7 aa, Corononavirus-HKU1
LLVKEPV

SEQ ID NO: 1488 - protein, 13 aa, Corononavirus-HKU1
PHCCISTISGLYT

SEQ ID NO: 1489 - protein, 6 aa, Corononavirus-HKU1
LWRQQP

SEQ ID NO: 1490 - protein, 5 aa, Corononavirus-HKU1
PVLEL

SEQ ID NO: 1491 - protein, 43 aa, Corononavirus-HKU1
HVARLEHTLQLSSLPNLAKYLKQVSSKLADQVINTTLSERSKR

SEQ ID NO: 1492 - protein, 4 aa, Corononavirus-HKU1
SDNI

SEQ ID NO: 1493 - protein, 10 aa, Corononavirus-HKU1
TILILTISHF

SEQ ID NO: 1494 - protein, 25 aa, Corononavirus-HKU1
PFDIRGIKCLNFSPGGALATVFLKV

SEQ ID NO: 1495 - protein, 35 aa, Corononavirus-HKU1
QSLSANKPVASTTKSTPVEKPICSGKFVPMFSRVA

SEQ ID NO: 1496 - protein, 25 aa, Corononavirus-HKU1
APSTSKPTQPLTRLMASSLVINNLE

SEQ ID NO: 1497 - protein, 50 aa, Corononavirus-HKU1
PSRVKSNLKPIRDIKREYVKTGSQIFKFTAKFSLTLYLSSTAKNEGACAG

SEQ ID NO: 1498 - protein, 21 aa, Corononavirus-HKU1
PKQLLLQSLKRLVVQCKRGKV

SEQ ID NO: 1499 - protein, 52 aa, Corononavirus-HKU1
ILSKGRVIKLRDSNNCILLITQKMPFLALVMATLNRLTLTEWAVSAVCEYIT

SEQ ID NO: 1500 - protein, 5 aa, Corononavirus-HKU1
SYSEP

SEQ ID NO: 1501 - protein, 7 aa, Corononavirus-HKU1
AESTVCV

SEQ ID NO: 1502 - protein, 8 aa, Corononavirus-HKU1
TPKTRLAT

SEQ ID NO: 1503 - protein, 23 aa, Corononavirus-HKU1
GLIKTALFQTGLAFKNLLIRYIC

SEQ ID NO: 1504 - protein, 33 aa, Corononavirus-HKU1
IFTALELSCVVCPLKYTLKHNELLSFLALSLLS

SEQ ID NO: 1505 - protein, 14 aa, Corononavirus-HKU1
TNAETVSTISLGHL

SEQ ID NO: 1506 - protein, 37 aa, Corononavirus-HKU1
QFPKKISGPKQHIILVIELKCLGSKEPLLNSTRGAGN

SEQ ID NO: 1507 - protein, 7 aa, Corononavirus-HKU1
AGSPIYT

SEQ ID NO: 1508 - protein, 13 aa, Corononavirus-HKU1
CLALIRAFITDNS

SEQ ID NO: 1509 - protein, 38 aa, Corononavirus-HKU1
LVSILTSSTTTISVTNSGNAFIVVKTYLQVVSLILNLS

SEQ ID NO: 1510 - protein, 20 aa, Corononavirus-HKU1
QSTRTLAGIIRVQSLIFKNL

SEQ ID NO: 1511 - protein, 10 aa, Corononavirus-HKU1
AFSHNASTAA

SEQ ID NO: 1512 - protein, 4 aa, Corononavirus-HKU1
LAAV

SEQ ID NO: 1513 - protein, 5 aa, Corononavirus-HKU1
TTRAV

SEQ ID NO: 1514 - protein, 7 aa, Corononavirus-HKU1
TARPIAR

SEQ ID NO: 1515 - protein, 8 aa, Corononavirus-HKU1
DFPVPGGP

SEQ ID NO: 1516 - protein, 6 aa, Corononavirus-HKU1
RFIPMC

SEQ ID NO: 1517 - protein, 5 aa, Corononavirus-HKU1
LATLF

SEQ ID NO: 1518 - protein, 6 aa, Corononavirus-HKU1
NTNGTL

SEQ ID NO: 1519 - protein, 8 aa, Corononavirus-HKU1
TLENLILA

SEQ ID NO: 1520 - protein, 28 aa, Corononavirus-HKU1
FSCGTSVGALKLATECDVKTKTSPIESL

SEQ ID NO: 1521 - protein, 5 aa, Corononavirus-HKU1
VVVAR

SEQ ID NO: 1522 - protein, 25 aa, Corononavirus-HKU1
YTPLVNSLLSKTYSPKTVLPVLVKW

SEQ ID NO: 1523 - protein, 4 aa, Corononavirus-HKU1
PVKT

SEQ ID NO: 1524 - protein, 24 aa, Corononavirus-HKU1
FLLSGGLTLPVSQHKITSLSLTIS

SEQ ID NO: 1525 - protein, 5 aa, Corononavirus-HKU1
MVAEA

SEQ ID NO: 1526 - protein, 10 aa, Corononavirus-HKU1
LCLKASSVAF

SEQ ID NO: 1527 - protein, 17 aa, Corononavirus-HKU1
VSAANNFKRSIHSFART

SEQ ID NO: 1528 - protein, 17 aa, Corononavirus-HKU1
SSTSVHLQLAILLKSSI

SEQ ID NO: 1529 - protein, 22 aa, Corononavirus-HKU1
GEPVQDCLYKPKTIPFITNLNE

SEQ ID NO: 1530 - protein, 7 aa, Corononavirus-HKU1
WGLWFSQ

SEQ ID NO: 1531 - protein, 21 aa, Corononavirus-HKU1
DIPPKYNLVTSLTSQLGALQT

SEQ ID NO: 1532 - protein, 8 aa, Corononavirus-HKU1
GETLKTYL

SEQ ID NO: 1533 - protein, 7 aa, Corononavirus-HKU1
LVAITWS

SEQ ID NO: 1534 - protein, 41 aa, Corononavirus-HKU1
QHLQHNKGLRIQLPQRKEVCDEQTTHAPTLCITALFKYIFL

SEQ ID NO: 1535 - protein, 17 aa, Corononavirus-HKU1
NDSSVNFKPSQVLKITL

SEQ ID NO: 1536 - protein, 4 aa, Corononavirus-HKU1
LSKI

SEQ ID NO: 1537 - protein, 25 aa, Corononavirus-HKU1
VPRSLYSFFIYSKYTRKTFWYSSFS

SEQ ID NO: 1538 - protein, 4 aa, Corononavirus-HKU1
CTKG

SEQ ID NO: 1539 - protein, 38 aa, Corononavirus-HKU1
ASIARLTKRSIKRTLSVFNKSSTKQPAPKILEGSGYGK

SEQ ID NO: 1540 - protein, 15 aa, Corononavirus-HKU1
SPSILTNIVCWEQNS

SEQ ID NO: 1541 - protein, 20 aa, Corononavirus-HKU1
GPLVISFSTQHLDSDIKTLF

SEQ ID NO: 1542 - protein, 4 aa, Corononavirus-HKU1
YKTC

SEQ ID NO: 1543 - protein, 7 aa, Corononavirus-HKU1
KTLILAI

SEQ ID NO: 1544 - protein, 4 aa, Corononavirus-HKU1
PLLA

SEQ ID NO: 1545 - protein, 19 aa, Corononavirus-HKU1
QTTPSSLKIIILKCLHKNS

SEQ ID NO: 1546 - protein, 6 aa, Corononavirus-HKU1
YSLTNV

SEQ ID NO: 1547 - protein, 33 aa, Corononavirus-HKU1
TLEYKRFCKLRILKSSILWPLQAIREQTLAVTA

SEQ ID NO: 1548 - protein, 23 aa, Corononavirus-HKU1
HILKTELAKAVVASPLLVPPGLT

SEQ ID NO: 1549 - protein, 11 aa, Corononavirus-HKU1
QPPHITISLKT

SEQ ID NO: 1550 - protein, 7 aa, Corononavirus-HKU1
AHSFARR

SEQ ID NO: 1551 - protein, 33 aa, Corononavirus-HKU1
NLSPCEQQNSCLRAKTKLLTIRKIFGIARSHLG

SEQ ID NO: 1552 - protein, 14 aa, Corononavirus-HKU1
SQPIRTGLSTSFIR

SEQ ID NO: 1553 - protein, 8 aa, Corononavirus-HKU1
RNISSQPP

SEQ ID NO: 1554 - protein, 21 aa, Corononavirus-HKU1
NLVVPITTGTPRVAAILFKHF

SEQ ID NO: 1555 - protein, 31 aa, Corononavirus-HKU1
WNIRPVIVLRIETPATVRALFLALIAYFKFI

SEQ ID NO: 1556 - protein, 12 aa, Corononavirus-HKU1
VKVGRTLRLVYA

SEQ ID NO: 1557 - protein, 11 aa, Corononavirus-HKU1
ISFCSSNDNAS

SEQ ID NO: 1558 - protein, 10 aa, Corononavirus-HKU1
SLALPNLLNG

SEQ ID NO: 1559 - protein, 5 aa, Corononavirus-HKU1
PALLS

SEQ ID NO: 1560 - protein, 14 aa, Corononavirus-HKU1
LLTITCDAGIQPPS

SEQ ID NO: 1561 - protein, 5 aa, Corononavirus-HKU1
ISKYL

SEQ ID NO: 1562 - protein, 20 aa, Corononavirus-HKU1
TTSNTNNNCLISTIVGKLYL

SEQ ID NO: 1563 - protein, 8 aa, Corononavirus-HKU1
SVIAALPS

SEQ ID NO: 1564 - protein, 23 aa, Corononavirus-HKU1
VKKKCFKSTVLPSLNKPLLLTNS

SEQ ID NO: 1565 - protein, 11 aa, Corononavirus-HKU1
KSWLKLPGFTV

SEQ ID NO: 1566 - protein, 33 aa, Corononavirus-HKU1
NFIPLVMAATLKQQVRKSSRALADATCIAGSAA

SEQ ID NO: 1567 - protein, 9 aa, Corononavirus-HKU1
RSKSLRDKR

SEQ ID NO: 1568 - protein, 15 aa, Corononavirus-HKU1
RCVSTSKFITTPNSL

SEQ ID NO: 1569 - protein, 36 aa, Corononavirus-HKU1
PIETTNGTPSTKICLTRGPKQVLGKTILNSILKLAQ

SEQ ID NO: 1570 - protein, 13 aa, Corononavirus-HKU1
IIHLSLSQSTVLG

SEQ ID NO: 1571 - protein, 16 aa, Corononavirus-HKU1
YFIPQYLKYLLNNSNL

SEQ ID NO: 1572 - protein, 12 aa, Corononavirus-HKU1
SVKSYCTRSNCL

SEQ ID NO: 1573 - protein, 11 aa, Corononavirus-HKU1
LSLTNNSQSNT

SEQ ID NO: 1574 - protein, 8 aa, Corononavirus-HKU1
HIVNIGII

SEQ ID NO: 1575 - protein, 21 aa, Corononavirus-HKU1
ESATATPNPGAVCIKSPKSYH

SEQ ID NO: 1576 - protein, 58 aa, Corononavirus-HKU1
PYKSWLSKVKTPTKPTSTKVSAKMTVLSKALLKIGPNFLYILIISGFSTKSYQSFLEK

SEQ ID NO: 1577 - protein, 22 aa, Corononavirus-HKU1
DSLQSAYSQRISHNIEQSLRSK

SEQ ID NO: 1578 - protein, 41 aa, Corononavirus-HKU1
QRSNIVYFERFLRTICGTRLPSISNVKKSCSATTPQLLVNS

SEQ ID NO: 1579 - protein, 5 aa, Corononavirus-HKU1
VFSLL

SEQ ID NO: 1580 - protein, 22 aa, Corononavirus-HKU1
TSKLVLLTTKNLSNLLPSSSIR

SEQ ID NO: 1581 - protein, 7 aa, Corononavirus-HKU1
KRQQFTL

SEQ ID NO: 1582 - protein, 17 aa, Corononavirus-HKU1
YKPIPALLVLQMSNALN

SEQ ID NO: 1583 - protein, 28 aa, Corononavirus-HKU1
TSVDKPLAQGTSRAFTLVPRTRLKNLNL

SEQ ID NO: 1584 - protein, 31 aa, Corononavirus-HKU1
IEQRHLNLHRNNCHLSKNHRLDKHHVLTHKE

SEQ ID NO: 1585 - protein, 42 aa, Corononavirus-HKU1
DLLYPKGLVQIYHVIYIYHLHLDALHVHGNKYKLRHHHKNLG

SEQ ID NO: 1586 - protein, 12 aa, Corononavirus-HKU1
WPYQYQHDHRAF

SEQ ID NO: 1587 - protein, 13 aa, Corononavirus-HKU1
VHHLVVYNLNKFS

SEQ ID NO: 1588 - protein, 10 aa, Corononavirus-HKU1
DLQKMHIMKV

SEQ ID NO: 1589 - protein, 4 aa, Corononavirus-HKU1
LHTQ

SEQ ID NO: 1590 - protein, 6 aa, Corononavirus-HKU1
QHQPAI

SEQ ID NO: 1591 - protein, 11 aa, Corononavirus-HKU1
LLKIKYQQPTL

SEQ ID NO: 1592 - protein, 6 aa, Corononavirus-HKU1
LKCYIL

SEQ ID NO: 1593 - protein, 4 aa, Corononavirus-HKU1
NKDT

SEQ ID NO: 1594 - protein, 20 aa, Corononavirus-HKU1
KIYKEDQALKQHNFHHLSLS

SEQ ID NO: 1595 - protein, 5 aa, Corononavirus-HKU1
DHQHH

SEQ ID NO: 1596 - protein, 17 aa, Corononavirus-HKU1
EQHKLFYHYYHYYNNIE

SEQ ID NO: 1597 - protein, 10 aa, Corononavirus-HKU1
EYYNSYQNHY

SEQ ID NO: 1598 - protein, 15 aa, Corononavirus-HKU1
QLVFLIYEASTHYSA

SEQ ID NO: 1599 - protein, 8 aa, Corononavirus-HKU1
QLHYTCSQ

SEQ ID NO: 1600 - protein, 4 aa, Corononavirus-HKU1
QEAN

SEQ ID NO: 1601 - protein, 6 aa, Corononavirus-HKU1
YQLTVY

SEQ ID NO: 1602 - protein, 17 aa, Corononavirus-HKU1
YHQHLEQSVYAIHYQHM

SEQ ID NO: 1603 - protein, 17 aa, Corononavirus-HKU1
HKHYQQLYQKLVYLVLL

SEQ ID NO: 1604 - protein, 5 aa, Corononavirus-HKU1
QPMLE

SEQ ID NO: 1605 - protein, 7 aa, Corononavirus-HKU1
HSKVHNL

SEQ ID NO: 1606 - protein, 5 aa, Corononavirus-HKU1
QHYPE

SEQ ID NO: 1607 - protein, 12 aa, Corononavirus-HKU1
NLKPDYPIYEPC

SEQ ID NO: 1608 - protein, 15 aa, Corononavirus-HKU1
KALSAKRKQLYSSYH

SEQ ID NO: 1609 - protein, 7 aa, Corononavirus-HKU1
SEPLYTC

SEQ ID NO: 1610 - protein, 21 aa, Corononavirus-HKU1
VLGLPYVQVCELQLYHVHTQT

SEQ ID NO: 1611 - protein, 14 aa, Corononavirus-HKU1
LYYMLFLTVLSVVD

SEQ ID NO: 1612 - protein, 5 aa, Corononavirus-HKU1
QNHYF

SEQ ID NO: 1613 - protein, 14 aa, Corononavirus-HKU1
HQPNFSLRLHIQQN

SEQ ID NO: 1614 - protein, 21 aa, Corononavirus-HKU1
PYLQTHFAKPAKRYYLEHNHR

SEQ ID NO: 1615 - protein, 8 aa, Corononavirus-HKU1
LHLYLQDT

SEQ ID NO: 1616 - protein, 26 aa, Corononavirus-HKU1
YQLQQDWRIKQSIIEQAYQKLHSNLK

SEQ ID NO: 1617 - protein, 14 aa, Corononavirus-HKU1
IVFHYVKHYNTATT

SEQ ID NO: 1618 - protein, 14 aa, Corononavirus-HKU1
KQHANAVNNLTKQH

SEQ ID NO: 1619 - protein, 15 aa, Corononavirus-HKU1
HISHQSILIEFGRLQ

SEQ ID NO: 1620 - protein, 14 aa, Corononavirus-HKU1
LARHLFQAVLNLTK

SEQ ID NO: 1621 - protein, 11 aa, Corononavirus-HKU1
PQNYYEVDVSH

SEQ ID NO: 1622 - protein, 17 aa, Corononavirus-HKU1
HSYNAILEQKFYNYKHP

SEQ ID NO: 1623 - protein, 18 aa, Corononavirus-HKU1
KHCLKERKIPNNKIKYTL

SEQ ID NO: 1624 - protein, 8 aa, Corononavirus-HKU1
ISNSRESI

SEQ ID NO: 1625 - protein, 5 aa, Corononavirus-HKU1
YKVHL

SEQ ID NO: 1626 - protein, 4 aa, Corononavirus-HKU1
NKIY

SEQ ID NO: 1627 - protein, 4 aa, Corononavirus-HKU1
QTTN

SEQ ID NO: 1628 - protein, 5 aa, Corononavirus-HKU1
QQFLL

SEQ ID NO: 1629 - protein, 4 aa, Corononavirus-HKU1
LMTK

SEQ ID NO: 1630 - protein, 10 aa, Corononavirus-HKU1
WSMYKYLKRL

SEQ ID NO: 1631 - protein, 14 aa, Corononavirus-HKU1
ITKHPLLNSTQNTT

SEQ ID NO: 1632 - protein, 14 aa, Corononavirus-HKU1
LFYQPKTSKKKCHD

SEQ ID NO: 1633 - protein, 15 aa, Corononavirus-HKU1
QKHIKYNHKILHKHK

SEQ ID NO: 1634 - protein, 13 aa, Corononavirus-HKU1
NSQQEQNMRARHK

SEQ ID NO: 1635 - protein, 22 aa, Corononavirus-HKU1
NLPYKQLNNLHKTRYRVQELYT

SEQ ID NO: 1636 - protein, 7 aa, Corononavirus-HKU1
SNKNAYV

SEQ ID NO: 1637 - protein, 4 aa, Corononavirus-HKU1
LVTS

SEQ ID NO: 1638 - protein, 7 aa, Corononavirus-HKU1
QNKVHIM

SEQ ID NO: 1639 - protein, 6 aa, Corononavirus-HKU1
HQSYVY

SEQ ID NO: 1640 - protein, 7 aa, Corononavirus-HKU1
QMQKLYN

SEQ ID NO: 1641 - protein, 9 aa, Corononavirus-HKU1
ISKSNKLFL

SEQ ID NO: 1642 - protein, 4 aa, Corononavirus-HKU1
IFLF

SEQ ID NO: 1643 - protein, 33 aa, Corononavirus-HKU1
HQPIVDKRQKVPIHLQKYNFLVFDDLEIPYIDA

SEQ ID NO: 1644 - protein, 6 aa, Corononavirus-HKU1
QPIKFQ

SEQ ID NO: 1645 - protein, 18 aa, Corononavirus-HKU1
KHLSLKPKHLRQDLLLLG

SEQ ID NO: 1646 - protein, 4 aa, Corononavirus-HKU1
NHLP

SEQ ID NO: 1647 - protein, 12 aa, Corononavirus-HKU1
NKHHFVQTKHNY

SEQ ID NO: 1648 - protein, 6 aa, Corononavirus-HKU1
LHRAKQ

SEQ ID NO: 1649 - protein, 6 aa, Corononavirus-HKU1
QSGRSP

SEQ ID NO: 1650 - protein, 17 aa, Corononavirus-HKU1
LATVQLEHLYMDHKNYQ

SEQ ID NO: 1651 - protein, 9 aa, Corononavirus-HKU1
NQCQCDNQY

SEQ ID NO: 1652 - protein, 9 aa, Corononavirus-HKU1
ALIDAYIQT

SEQ ID NO: 1653 - protein, 20 aa, Corononavirus-HKU1
HYHLLIHNQQIHMTHTKKNL

SEQ ID NO: 1654 - protein, 5 aa, Corononavirus-HKU1
YNYYA

SEQ ID NO: 1655 - protein, 15 aa, Corononavirus-HKU1
HEMPLVVGHYTQLKQ

SEQ ID NO: 1656 - protein, 5 aa, Corononavirus-HKU1
KFHQV

SEQ ID NO: 1657 - protein, 38 aa, Corononavirus-HKU1
HYQKYILECKDFVKRLSKQVDSPASGKTQLLNSSDQTL

SEQ ID NO: 1658 - protein, 4 aa, Corononavirus-HKU1
NHLE

SEQ ID NO: 1659 - protein, 13 aa, Corononavirus-HKU1
LYTIRQNNQVRSY

SEQ ID NO: 1660 - protein, 4 aa, Corononavirus-HKU1
RMNI

SEQ ID NO: 1661 - protein, 21 aa, Corononavirus-HKU1
HDEDNKLCHLTINHSKSYYHK

SEQ ID NO: 1662 - protein, 8 aa, Corononavirus-HKU1
QYKVQFLT

SEQ ID NO: 1663 - protein, 13 aa, Corononavirus-HKU1
EIPSLQYLIAKKM

SEQ ID NO: 1664 - protein, 4 aa, Corononavirus-HKU1
KQML

SEQ ID NO: 1665 - protein, 12 aa, Corononavirus-HKU1
EVGIRHHYHYCD

SEQ ID NO: 1666 - protein, 46 aa, Corononavirus-HKU1
LTENTPLLYRQQYPFYHYSNDTYYTNSNIYCRQHQKQNSLIYNKNL

SEQ ID NO: 1667 - protein, 12 aa, Corononavirus-HKU1
EMFLQMYYHYIH

SEQ ID NO: 1668 - protein, 16 aa, Corononavirus-HKU1
HQFSYNMKITIKHGLQ

SEQ ID NO: 1669 - protein, 7 aa, Corononavirus-HKU1
HKTKKAL

SEQ ID NO: 1670 - protein, 6 aa, Corononavirus-HKU1
QSIANA

SEQ ID NO: 1671 - protein, 20 aa, Corononavirus-HKU1
FQKENTMLHKNKNKHKHMHK

SEQ ID NO: 1672 - protein, 8 aa, Corononavirus-HKU1
DKLEKQKA

SEQ ID NO: 1673 - protein, 7 aa, Corononavirus-HKU1
YTKQQHL

SEQ ID NO: 1674 - protein, 7 aa, Corononavirus-HKU1
YNLQKHA

SEQ ID NO: 1675 - protein, 12 aa, Corononavirus-HKU1
VLLNNKKPRQQL

SEQ ID NO: 1676 - protein, 5 aa, Corononavirus-HKU1
EKRNL

SEQ ID NO: 1677 - protein, 5 aa, Corononavirus-HKU1
DELNY

SEQ ID NO: 1678 - protein, 30 aa, Corononavirus-HKU1
KIDKTNQKDLYHKKFQAYFYNNHYSKPRNY

SEQ ID NO: 1679 - protein, 17 aa, Corononavirus-HKU1
NIYPLRRIHMHPLYNKS

SEQ ID NO: 1680 - protein, 11 aa, Corononavirus-HKU1
SAFLQYVQYLH

SEQ ID NO: 1681 - protein, 5 aa, Corononavirus-HKU1
HQEIL

SEQ ID NO: 1682 - protein, 18 aa, Corononavirus-HKU1
QGYNVYVEPKMYTKKHSS

SEQ ID NO: 1683 - protein, 15 aa, Corononavirus-HKU1
HHLNNNKDVVYHHLF

SEQ ID NO: 1684 - protein, 9 aa, Corononavirus-HKU1
YTKMIKHNH

SEQ ID NO: 1685 - protein, 19 aa, Corononavirus-HKU1
HKNHYKKSEYVVYSTEHYH

SEQ ID NO: 1686 - protein, 17 aa, Corononavirus-HKU1
QMHKLKNVKHESHVSKL

SEQ ID NO: 1687 - protein, 6 aa, Corononavirus-HKU1
NRYLHP

SEQ ID NO: 1688 - protein, 4 aa, Corononavirus-HKU1
LPLQ

SEQ ID NO: 1689 - protein, 21 aa, Corononavirus-HKU1
NYDSKQTQKWTHTIDQIGKIY

SEQ ID NO: 1690 - protein, 5 aa, Corononavirus-HKU1
QNINH

SEQ ID NO: 1691 - protein, 4 aa, Corononavirus-HKU1
LKYL

SEQ ID NO: 1692 - protein, 5 aa, Corononavirus-HKU1
QHHYQ

SEQ ID NO: 1693 - protein, 14 aa, Corononavirus-HKU1
HKQANEYQTYKHYM

SEQ ID NO: 1694 - protein, 7 aa, Corononavirus-HKU1
AIKPTII

SEQ ID NO: 1695 - protein, 4 aa, Corononavirus-HKU1
NRLN

SEQ ID NO: 1696 - protein, 15 aa, Corononavirus-HKU1
QKIIYITNYSIQHLL

SEQ ID NO: 1697 - protein, 5 aa, Corononavirus-HKU1
VKRVL

SEQ ID NO: 1698 - protein, 7 aa, Corononavirus-HKU1
GHLPLAY

SEQ ID NO: 1699 - protein, 9 aa, Corononavirus-HKU1
KSILTSSQF

SEQ ID NO: 1700 - protein, 12 aa, Corononavirus-HKU1
HMLFLIYAVNQQ

SEQ ID NO: 1701 - protein, 6 aa, Corononavirus-HKU1
TIYKKY

SEQ ID NO: 1702 - protein, 7 aa, Corononavirus-HKU1
QHYPVHA

SEQ ID NO: 1703 - protein, 4 aa, Corononavirus-HKU1
HHSV

SEQ ID NO: 1704 - protein, 15 aa, Corononavirus-HKU1
EHLNQQLQYYHSLNM

SEQ ID NO: 1705 - protein, 9 aa, Corononavirus-HKU1
VPNCYNFHQ

SEQ ID NO: 1706 - protein, 10 aa, Corononavirus-HKU1
IPNQQLLQIS

SEQ ID NO: 1707 - protein, 30 aa, Corononavirus-HKU1
ILFQHLNQWNNIYVHIPQKYLKPFLIAHPL

SEQ ID NO: 1708 - protein, 6 aa, Corononavirus-HKU1
EKHEQC

SEQ ID NO: 1709 - protein, 10 aa, Corononavirus-HKU1
NSFYQHQNET

SEQ ID NO: 1710 - protein, 8 aa, Corononavirus-HKU1
KYQHKHQT

SEQ ID NO: 1711 - protein, 10 aa, Corononavirus-HKU1
SGLQRYHYKL

SEQ ID NO: 1712 - protein, 8 aa, Corononavirus-HKU1
LTFCLQVI

SEQ ID NO: 1713 - protein, 15 aa, Corononavirus-HKU1
AYTMIVHKTQQHSEN

SEQ ID NO: 1714 - protein, 13 aa, Corononavirus-HKU1
LYQHHSLLQLHTN

SEQ ID NO: 1715 - protein, 5 aa, Corononavirus-HKU1
NVTDY

SEQ ID NO: 1716 - protein, 5 aa, Corononavirus-HKU1
YLQIN

SEQ ID NO: 1717 - protein, 23 aa, Corononavirus-HKU1
HQHHRKHAVHLYHRTNASYNQLA

SEQ ID NO: 1718 - protein, 13 aa, Corononavirus-HKU1
LHNVKHQLDLQVV

SEQ ID NO: 1719 - protein, 5 aa, Corononavirus-HKU1
QLLQL

SEQ ID NO: 1720 - protein, 5 aa, Corononavirus-HKU1
KCYLV

SEQ ID NO: 1721 - protein, 4 aa, Corononavirus-HKU1
KNGN

SEQ ID NO: 1722 - protein, 6 aa, Corononavirus-HKU1
NNSIDV

SEQ ID NO: 1723 - protein, 7 aa, Corononavirus-HKU1
HKNQYHH

SEQ ID NO: 1724 - protein, 10 aa, Corononavirus-HKU1
YHNNELHHQQ

SEQ ID NO: 1725 - protein, 23 aa, Corononavirus-HKU1
HEHYNFVYNKINNQLYYNHRQYA

SEQ ID NO: 1726 - protein, 6 aa, Corononavirus-HKU1
NQLLYT

SEQ ID NO: 1727 - protein, 14 aa, Corononavirus-HKU1
QLYKTATRQKQVTY

SEQ ID NO: 1728 - protein, 4 aa, Corononavirus-HKU1
LQIQ

SEQ ID NO: 1729 - protein, 4 aa, Corononavirus-HKU1
STNA

SEQ ID NO: 1730 - protein, 6 aa, Corononavirus-HKU1
TNQATM

SEQ ID NO: 1731 - protein, 5 aa, Corononavirus-HKU1
IIVNQ

SEQ ID NO: 1732 - protein, 15 aa, Corononavirus-HKU1
DKIMDKTILCIMNNQ

SEQ ID NO: 1733 - protein, 6 aa, Corononavirus-HKU1
RVQQLI

SEQ ID NO: 1734 - protein, 16 aa, Corononavirus-HKU1
HNQIKHVYLLHTEQNL

SEQ ID NO: 1735 - protein, 16 aa, Corononavirus-HKU1
LHMYPTYQNQNDTIHI

SEQ ID NO: 1736 - protein, 8 aa, Corononavirus-HKU1
NYHYKNDL

SEQ ID NO: 1737 - protein, 5 aa, Corononavirus-HKU1
NLHLT

SEQ ID NO: 1738 - protein, 6 aa, Corononavirus-HKU1
NKNHKL

SEQ ID NO: 1739 - protein, 4 aa, Corononavirus-HKU1
PNQK

SEQ ID NO: 1740 - protein, 4 aa, Corononavirus-HKU1
PLST

SEQ ID NO: 1741 - protein, 6 aa, Corononavirus-HKU1
QFFPQK

SEQ ID NO: 1742 - protein, 5 aa, Corononavirus-HKU1
EDKSH

SEQ ID NO: 1743 - protein, 6 aa, Corononavirus-HKU1
HLYTKN

SEQ ID NO: 1744 - protein, 14 aa, Corononavirus-HKU1
TKTKTQWLQQENLL

SEQ ID NO: 1745 - protein, 4 aa, Corononavirus-HKU1
IYSI

SEQ ID NO: 1746 - protein, 6 aa, Corononavirus-HKU1
MSEKHF

SEQ ID NO: 1747 - protein, 6 aa, Corononavirus-HKU1
EPNKTN

SEQ ID NO: 1748 - protein, 4 aa, Corononavirus-HKU1
KLFL

SEQ ID NO: 1749 - protein, 8 aa, Corononavirus-HKU1
YKKWFYHL

SEQ ID NO: 1750 - protein, 4 aa, Corononavirus-HKU1
NVIN

SEQ ID NO: 1751 - protein, 10 aa, Corononavirus-HKU1
TTTSKNHKIL

SEQ ID NO: 1752 - protein, 15 aa, Corononavirus-HKU1
ELKEFDYHLLNITNL

SEQ ID NO: 1753 - protein, 7 aa, Corononavirus-HKU1
YHIVYIP

SEQ ID NO: 1754 - protein, 4 aa, Corononavirus-HKU1
LLVI

SEQ ID NO: 1755 - protein, 6 aa, Corononavirus-HKU1
LGVTIH

SEQ ID NO: 1756 - protein, 22 aa, Corononavirus-HKU1
QPKQHNHNLSNTYPKHQLKINF

SEQ ID NO: 1757 - protein, 5 aa, Corononavirus-HKU1
NYFHH

SEQ ID NO: 1758 - protein, 4 aa, Corononavirus-HKU1
HLLF

SEQ ID NO: 1759 - protein, 4 aa, Corononavirus-HKU1
HPLT

SEQ ID NO: 1760 - protein, 4 aa, Corononavirus-HKU1
SAIP

SEQ ID NO: 1761 - protein, 22 aa, Corononavirus-HKU1
PHYLVTPQIQNQQTKHYIYFQI

SEQ ID NO: 1762 - protein, 12 aa, Corononavirus-HKU1
ENSMMLHHDKTK

SEQ ID NO: 1763 - protein, 9 aa, Corononavirus-HKU1
QAYQKFHIL

SEQ ID NO: 1764 - protein, 16 aa, Corononavirus-HKU1
NNVSHINHQMPKQHHQ

SEQ ID NO: 1765 - protein, 16 aa, Corononavirus-HKU1
LQARLLLCTQQTANLH

SEQ ID NO: 1766 - protein, 16 aa, Corononavirus-HKU1
NLTYHSIEHKYHVQLT

SEQ ID NO: 1767 - protein, 6 aa, Corononavirus-HKU1
YKHRQL

SEQ ID NO: 1768 - protein, 4 aa, Corononavirus-HKU1
TEPL

SEQ ID NO: 1769 - protein, 29 aa, Corononavirus-HKU1
VLYNTYHYHNNIVKDQGYKQPFQHHPKNN

SEQ ID NO: 1770 - protein, 6 aa, Corononavirus-HKU1
KSGLNF

SEQ ID NO: 1771 - protein, 9 aa, Corononavirus-HKU1
DTSSQLNNH

SEQ ID NO: 1772 - protein, 5 aa, Corononavirus-HKU1
HLYIF

SEQ ID NO: 1773 - protein, 24 aa, Corononavirus-HKU1
HYKHHNVGKVNHISNVYNGLHLHP

SEQ ID NO: 1774 - protein, 14 aa, Corononavirus-HKU1
LQQHHQVNPYSEEY

SEQ ID NO: 1775 - protein, 9 aa, Corononavirus-HKU1
NKSKMVHSI

SEQ ID NO: 1776 - protein, 16 aa, Corononavirus-HKU1
YNGQFYLHNYSQSYNH

SEQ ID NO: 1777 - protein, 11 aa, Corononavirus-HKU1
KDQSLLMYQNA

SEQ ID NO: 1778 - protein, 10 aa, Corononavirus-HKU1
QHQHQHDFLV

SEQ ID NO: 1779 - protein, 5 aa, Corononavirus-HKU1
YHNHK

SEQ ID NO: 1780 - protein, 18 aa, Corononavirus-HKU1
VLIHKLHLINQLVSKQHE

SEQ ID NO: 1781 - protein, 7 aa, Corononavirus-HKU1
HLMVHQI

SEQ ID NO: 1782 - protein, 25 aa, Corononavirus-HKU1
LKQEQLTYVVCQHEIHTMLPATAIY

SEQ ID NO: 1783 - protein, 4 aa, Corononavirus-HKU1
YAAT

SEQ ID NO: 1784 - protein, 20 aa, Corononavirus-HKU1
DKLHSHNNYYETVQKKKMDR

SEQ ID NO: 1785 - protein, 53 aa, Corononavirus-HKU1
QLQTIYILLKNYNKQAIVADQTQMNFVQQKYQLKTNFHTDIKFYRHKNHYTLT

SEQ ID NO: 1786 - protein, 19 aa, Corononavirus-HKU1
HQCHHRKHYQVFYQKLHLQ

SEQ ID NO: 1787 - protein, 4 aa, Corononavirus-HKU1
HHLQ

SEQ ID NO: 1788 - protein, 6 aa, Corononavirus-HKU1
AKHLSS

SEQ ID NO: 1789 - protein, 7 aa, Corononavirus-HKU1
LIKHKLD

SEQ ID NO: 1790 - protein, 22 aa, Corononavirus-HKU1
QLLYKKNHHIHNQSLYPDYIYK

SEQ ID NO: 1791 - protein, 5 aa, Corononavirus-HKU1
DTQNT

SEQ ID NO: 1792 - protein, 4 aa, Corononavirus-HKU1
HQIY

SEQ ID NO: 1793 - protein, 4 aa, Corononavirus-HKU1
DANL

SEQ ID NO: 1794 - protein, 22 aa, Corononavirus-HKU1
TTNNHERHYSIVYHDEAIKLLV

SEQ ID NO: 1795 - protein, 22 aa, Corononavirus-HKU1
QKNLKQNNHHHSKKVCMHLSQI

SEQ ID NO: 1796 - protein, 4 aa, Corononavirus-HKU1
HGLH

SEQ ID NO: 1797 - protein, 4 aa, Corononavirus-HKU1
QPML

SEQ ID NO: 1798 - protein, 5 aa, Corononavirus-HKU1
YQQLK

SEQ ID NO: 1799 - protein, 5 aa, Corononavirus-HKU1
FDIFE

SEQ ID NO: 1800 - protein, 8 aa, Corononavirus-HKU1
YQNLLYYY

SEQ ID NO: 1801 - protein, 18 aa, Corononavirus-HKU1
LVYQQHLEGKLMTHQQEH

SEQ ID NO: 1802 - protein, 5 aa, Corononavirus-HKU1
IYQPI

SEQ ID NO: 1803 - protein, 7 aa, Corononavirus-HKU1
TNNNHNY

SEQ ID NO: 1804 - protein, 17 aa, Corononavirus-HKU1
DAYKHVLTKHKIVFHLV

SEQ ID NO: 1805 - protein, 6 aa, Corononavirus-HKU1
HQGLQY

SEQ ID NO: 1806 - protein, 9 aa, Corononavirus-HKU1
ELFYIIYHR

SEQ ID NO: 1807 - protein, 11 aa, Corononavirus-HKU1
KHNNLLLGKHL

SEQ ID NO: 1808 - protein, 4 aa, Corononavirus-HKU1
QQFL

SEQ ID NO: 1809 - protein, 9 aa, Corononavirus-HKU1
KIFYLQLQL

SEQ ID NO: 1810 - protein, 12 aa, Corononavirus-HKU1
LLQLHHHGAYAH

SEQ ID NO: 1811 - protein, 4 aa, Corononavirus-HKU1
QNIH

SEQ ID NO: 1812 - protein, 16 aa, Corononavirus-HKU1
VLYTNHTIEVTQKKTY

SEQ ID NO: 1813 - protein, 7 aa, Corononavirus-HKU1
MTFHNLL

SEQ ID NO: 1814 - protein, 6 aa, Corononavirus-HKU1
NQIYHH

SEQ ID NO: 1815 - protein, 10 aa, Corononavirus-HKU1
QTYHLFVHHL

SEQ ID NO: 1816 - protein, 15 aa, Corononavirus-HKU1
QLQNDKRLHPQHMQQ

SEQ ID NO: 1817 - protein, 61 aa, Corononavirus-HKU1
GCKKHKNCHQIMKNVMYKVSPLLLESYYVHTYKHETQYLHKKTKHPNHLNQKKNHILNNTN

SEQ ID NO: 1818 - protein, 21 aa, Corononavirus-HKU1
YQTGLKTNKQNQLQNHLEAKQ

SEQ ID NO: 1819 - protein, 22 aa, Corononavirus-HKU1
WSVNNQQNFDYNPPYKITTYFQ

SEQ ID NO: 1820 - protein, 15 aa, Corononavirus-HKU1
KVISALQVTQNATNN

SEQ ID NO: 1821 - protein, 5 aa, Corononavirus-HKU1
VTINH

SEQ ID NO: 1822 - protein, 7 aa, Corononavirus-HKU1
NMFLFQH

SEQ ID NO: 1823 - protein, 9 aa, Corononavirus-HKU1
QTKHHYRHH

SEQ ID NO: 1824 - protein, 22 aa, Corononavirus-HKU1
KLKELYKYQSHKYFQYHLHHHQ

SEQ ID NO: 1825 - protein, 9 aa, Corononavirus-HKU1
QQFGHHCHQ

SEQ ID NO: 1826 - protein, 9 aa, Corononavirus-HKU1
QSLHRYCHQ

SEQ ID NO: 1827 - protein, 9 aa, Corononavirus-HKU1
QHLHRHCHQ

SEQ ID NO: 1828 - protein, 9 aa, Corononavirus-HKU1
QHLHRHCHQ

SEQ ID NO: 1829 - protein, 9 aa, Corononavirus-HKU1
QHLHRHCHQ

SEQ ID NO: 1830 - protein, 9 aa, Corononavirus-HKU1
QHLHRHCHQ

SEQ ID NO: 1831 - protein, 9 aa, Corononavirus-HKU1
QHLHRHCHQ

SEQ ID NO: 1832 - protein, 9 aa, Corononavirus-HKU1
QHLHRHCHQ

SEQ ID NO: 1833 - protein, 9 aa, Corononavirus-HKU1
QHLHRHCHQ

SEQ ID NO: 1834 - protein, 9 aa, Corononavirus-HKU1
QHLHRHCHQ

SEQ ID NO: 1835 - protein, 9 aa, Corononavirus-HKU1
QHLHRHCHQ

SEQ ID NO: 1836 - protein, 9 aa, Corononavirus-HKU1
QHLHRHCHQ

SEQ ID NO: 1837 - protein, 9 aa, Corononavirus-HKU1
QHLHRHCHQ

SEQ ID NO: 1838 - protein, 9 aa, Corononavirus-HKU1
QHLHRHCHQ

SEQ ID NO: 1839 - protein, 9 aa, Corononavirus-HKU1
QHLHRHCHQ

SEQ ID NO: 1840 - protein, 6 aa, Corononavirus-HKU1
QHLHRH

SEQ ID NO: 1841 - protein, 7 aa, Corononavirus-HKU1
CLQRHHQ

SEQ ID NO: 1842 - protein, 7 aa, Corononavirus-HKU1
YLRQLHY

SEQ ID NO: 1843 - protein, 6 aa, Corononavirus-HKU1
RLQHPQ

SEQ ID NO: 1844 - protein, 24 aa, Corononavirus-HKU1
QKYNTYERPLLHHQPHQINKQHSH

SEQ ID NO: 1845 - protein, 24 aa, Corononavirus-HKU1
VYLKMHELDNQPLDALYKSLKHSL

SEQ ID NO: 1846 - protein, 11 aa, Corononavirus-HKU1
HHKQQQQNHLQ

SEQ ID NO: 1847 - protein, 18 aa, Corononavirus-HKU1
HPFLLQILNKLYLKYHQK

SEQ ID NO: 1848 - protein, 5 aa, Corononavirus-HKU1
NLNQT

SEQ ID NO: 1849 - protein, 8 aa, Corononavirus-HKU1
LSSKTESP

SEQ ID NO: 1850 - protein, 5 aa, Corononavirus-HKU1
QQVSR

SEQ ID NO: 1851 - protein, 21 aa, Corononavirus-HKU1
LFYLHMENAKPDLKDKYFYHS

SEQ ID NO: 1852 - protein, 14 aa, Corononavirus-HKU1
GKIYHHTYPCTYYL

SEQ ID NO: 1853 - protein, 7 aa, Corononavirus-HKU1
YKFFLQI

SEQ ID NO: 1854 - protein, 12 aa, Corononavirus-HKU1
VVDNTHKMIKKI

SEQ ID NO: 1855 - protein, 5 aa, Corononavirus-HKU1
HHLLL

SEQ ID NO: 1856 - protein, 28 aa, Corononavirus-HKU1
QILQRLQKNKFVVPVHYMVKQNQELTLY

SEQ ID NO: 1857 - protein, 13 aa, Corononavirus-HKU1
RYKTYCLQYKLNH

SEQ ID NO: 1858 - protein, 10 aa, Corononavirus-HKU1
EQAYLLKHQL

SEQ ID NO: 1859 - protein, 6 aa, Corononavirus-HKU1
HTLIIT

SEQ ID NO: 1860 - protein, 6 aa, Corononavirus-HKU1
KKCKIY

SEQ ID NO: 1861 - protein, 9 aa, Corononavirus-HKU1
HNQVLKQQN

SEQ ID NO: 1862 - protein, 19 aa, Corononavirus-HKU1
SWLEILQKDHSIIGKEASL

SEQ ID NO: 1863 - protein, 5 aa, Corononavirus-HKU1
HLTWY

SEQ ID NO: 1864 - protein, 4 aa, Corononavirus-HKU1
YPIT

SEQ ID NO: 1865 - protein, 7 aa, Corononavirus-HKU1
HNALYKM

SEQ ID NO: 1866 - protein, 6 aa, Corononavirus-HKU1
QLKLCP

SEQ ID NO: 1867 - protein, 21 aa, Corononavirus-HKU1
TKYTFLNTYQKLLVKIETSKM

SEQ ID NO: 1868 - protein, 38 aa, Corononavirus-HKU1
RKYHSELDNNYGELNHLVKKVQNHLHKLQTCKQNQHDA

SEQ ID NO: 1869 - protein, 15 aa, Corononavirus-HKU1
QTSQYFLEAYYNHLY

SEQ ID NO: 1870 - protein, 9 aa, Corononavirus-HKU1
ATVAYTKNY

SEQ ID NO: 1871 - protein, 23 aa, Corononavirus-HKU1
RQEYDFVQDYHTYIEHNLSKVHE

SEQ ID NO: 1872 - protein, 4 aa, Corononavirus-HKU1
EQFL

SEQ ID NO: 1873 - protein, 15 aa, Corononavirus-HKU1
IYNLLHLNKPNHHKT

SEQ ID NO: 1874 - protein, 17 aa, Corononavirus-HKU1
ESTIQDAATNIYKNQMV

SEQ ID NO: 1875 - protein, 6 aa, Corononavirus-HKU1
QNNHTN

SEQ ID NO: 1876 - protein, 4 aa, Corononavirus-HKU1
KNHG

SEQ ID NO: 1877 - protein, 5 aa, Corononavirus-HKU1
QYQYY

SEQ ID NO: 1878 - protein, 7 aa, Corononavirus-HKU1
ITQDFQE

SEQ ID NO: 1879 - protein, 6 aa, Corononavirus-HKU1
HQMIGL

SEQ ID NO: 1880 - protein, 28 aa, Corononavirus-HKU1
SHKLYNTMDKKNHPSYYLKPNHKNHNYH

SEQ ID NO: 1881 - protein, 8 aa, Corononavirus-HKU1
NNLHNHTA

SEQ ID NO: 1882 - protein, 11 aa, Corononavirus-HKU1
QNHNHTNQHYI

SEQ ID NO: 1883 - protein, 7 aa, Corononavirus-HKU1
KNHPYES

SEQ ID NO: 1884 - protein, 4 aa, Corononavirus-HKU1
LSSN

SEQ ID NO: 1885 - protein, 17 aa, Corononavirus-HKU1
EALKLLHQQIINVQVHV

SEQ ID NO: 1886 - protein, 9 aa, Corononavirus-HKU1
LHLHLLHLL

SEQ ID NO: 1887 - protein, 5 aa, Corononavirus-HKU1
VVQHI

SEQ ID NO: 1888 - protein, 4 aa, Corononavirus-HKU1
SAGA

SEQ ID NO: 1889 - protein, 59 aa, Corononavirus-HKU1
QIVNHELHAKPLQYQSHNWQAIQTAFVSYLAKNNDHKLEDNLLIYQNSHNHTGLQKVRV

SEQ ID NO: 1890 - protein, 5 aa, Corononavirus-HKU1
YHDIV

SEQ ID NO: 1891 - protein, 11 aa, Corononavirus-HKU1
VKHKLFVNIYL

SEQ ID NO: 1892 - protein, 12 aa, Corononavirus-HKU1
AQHEPQHKHLLH

SEQ ID NO: 1893 - protein, 6 aa, Corononavirus-HKU1
NHNHQI

SEQ ID NO: 1894 - protein, 25 aa, Corononavirus-HKU1
NLKLLNHSLQYTTYRIETICEHKMA

SEQ ID NO: 1895 - protein, 14 aa, Corononavirus-HKU1
NQKVQSNPKNLHQN

SEQ ID NO: 1896 - protein, 8 aa, Corononavirus-HKU1
KDDVQHNV

SEQ ID NO: 1897 - protein, 8 aa, Corononavirus-HKU1
SCMNGTSP

SEQ ID NO: 1898 - protein, 10 aa, Corononavirus-HKU1
ENHPSYAKVI

SEQ ID NO: 1899 - protein, 11 aa, Corononavirus-HKU1
LKLPYRTLRLF

SEQ ID NO: 1900 - protein, 16 aa, Corononavirus-HKU1
LELLQHVDLHEQKYHG

SEQ ID NO: 1901 - protein, 33 aa, Corononavirus-HKU1
DLTAHAILVQECSDNLSSHDYHKRIQHFPSLDQ

SEQ ID NO: 1902 - protein, 10 aa, Corononavirus-HKU1
RGITHPHLTS

SEQ ID NO: 1903 - protein, 17 aa, Corononavirus-HKU1
PTPPLHPEAANEILAPT

SEQ ID NO: 1904 - protein, 8 aa, Corononavirus-HKU1
SRDRICWF

SEQ ID NO: 1905 - protein, 19 aa, Corononavirus-HKU1
SLRPMGGTLRTTNTSLAER

SEQ ID NO: 1906 - protein, 24 aa, Corononavirus-HKU1
KVWKVKYKIMIKPHSQAWITGNLV

SEQ ID NO: 1907 - protein, 18 aa, Corononavirus-HKU1
DLTRDRKLIDGTDAIRSY

SEQ ID NO: 1908 - DNA, 29942 bp, Corononavirus-HKU1; identical to SEQ ID NO: 1319
  CDS (2)..(29941)

SEQ ID NO: 1909 - protein, 13 aa, Corononavirus-HKU1
FFFFFVIPPKGYN

SEQ ID NO: 1910 - protein, 13 aa, Corononavirus-HKU1
FQSYTNIYIKHYN

SEQ ID NO: 1911 - protein, 30 aa, Corononavirus-HKU1
LFPEAFILQLNLITTLTIKCLNIKFLLINI

SEQ ID NO: 1912 - protein, 15 aa, Corononavirus-HKU1
SVTTYSICYYSKNSF

SEQ ID NO: 1913 - protein, 6 aa, Corononavirus-HKU1
RVSYSE

SEQ ID NO: 1914 - protein, 5 aa, Corononavirus-HKU1
RGVTT

SEQ ID NO: 1915 - protein, 8 aa, Corononavirus-HKU1
CRIRIHSH

SEQ ID NO: 1916 - protein, 6 aa, Corononavirus-HKU1
ATESST

SEQ ID NO: 1917 - protein, 9 aa, Corononavirus-HKU1
GSSRVASKL

SEQ ID NO: 1918 - protein, 10 aa, Corononavirus-HKU1
SSGVKSFEMC

SEQ ID NO: 1919 - protein, 21 aa, Corononavirus-HKU1
VPALKLRESNCSGNCLTPLLR

SEQ ID NO: 1920 - protein, 11 aa, Corononavirus-HKU1
GLELNESESVF

SEQ ID NO: 1921 - protein, 4 aa, Corononavirus-HKU1
LELT

SEQ ID NO: 1922 - protein, 26 aa, Corononavirus-HKU1
AFKFSSRTFIIVSKPGKVLSNLIEPE

SEQ ID NO: 1923 - protein, 39 aa, Corononavirus-HKU1
SSKTSLTGESASESLLTKSNLEPKKKAPGVGANSARIGN

SEQ ID NO: 1924 - protein, 15 aa, Corononavirus-HKU1
GSLVPSFNISALPKF

SEQ ID NO: 1925 - protein, 9 aa, Corononavirus-HKU1
EGPLLPKHC

SEQ ID NO: 1926 - protein, 30 aa, Corononavirus-HKU1
TLQCLLGVRFWRGFVKILCLISLAFCLVTC

SEQ ID NO: 1927 - protein, 45 aa, Corononavirus-HKU1
GLESLPSLAKTRLAISSAISGFTIESECLKLELLLLNERLLGPRD

SEQ ID NO: 1928 - protein, 17 aa, Corononavirus-HKU1
EREPGRLLEADLPEPST

SEQ ID NO: 1929 - protein, 14 aa, Corononavirus-HKU1
GKIVPGGNLVGIAS

SEQ ID NO: 1930 - protein, 17 aa, Corononavirus-HKU1
VVGSLDETSEGVEVSAW

SEQ ID NO: 1931 - protein, 12 aa, Corononavirus-HKU1
LATQKTPSRDSP

SEQ ID NO: 1932 - protein, 10 aa, Corononavirus-HKU1
DALAYGPVPR

SEQ ID NO: 1933 - protein, 10 aa, Corononavirus-HKU1
KYHLGNNCFC

SEQ ID NO: 1934 - protein, 30 aa, Corononavirus-HKU1
PSAVLKERRLCLYQYPFASEGGTPKAMGTP

SEQ ID NO: 1935 - protein, 10 aa, Corononavirus-HKU1
PSENLKSLPF

SEQ ID NO: 1936 - protein, 7 aa, Corononavirus-HKU1
VIPENQE

SEQ ID NO: 1937 - protein, 8 aa, Corononavirus-HKU1
CGIVFPCG

SEQ ID NO: 1938 - protein, 17 aa, Corononavirus-HKU1
VDTVNLGWVFLPLLKVW

SEQ ID NO: 1939 - protein, 26 aa, Corononavirus-HKU1
FRSDWSAQEVFLRIPERFPEELLLPA

SEQ ID NO: 1940 - protein, 5 aa, Corononavirus-HKU1
DILIV

SEQ ID NO: 1941 - protein, 17 aa, Corononavirus-HKU1
ALNKAVSIPLGLLDGKR

SEQ ID NO: 1942 - protein, 24 aa, Corononavirus-HKU1
LPTLDLTKTAKPLLTSNLSKKARL

SEQ ID NO: 1943 - protein, 19 aa, Corononavirus-HKU1
VQSTCTLATVTYTGKSERV

SEQ ID NO: 1944 - protein, 9 aa, Corononavirus-HKU1
PVPSLTPCI

SEQ ID NO: 1945 - protein, 9 aa, Corononavirus-HKU1
PRITVAVNV

SEQ ID NO: 1946 - protein, 41 aa, Corononavirus-HKU1
SSITGLTNILPFISIHIRLLVSGLKLHQLPVLIKSRILLTK

SEQ ID NO: 1947 - protein, 23 aa, Corononavirus-HKU1
RIHITIEIIVNTIENARKALFKA

SEQ ID NO: 1948 - protein, 23 aa, Corononavirus-HKU1
KQLNIVKVIVNGHISQRIIILIR

SEQ ID NO: 1949 - protein, 7 aa, Corononavirus-HKU1
TNILRLV

SEQ ID NO: 1950 - protein, 26 aa, Corononavirus-HKU1
PNCNMIVIKSSITPKEKFHSFKNVTA

SEQ ID NO: 1951 - protein, 4 aa, Corononavirus-HKU1
SEVN

SEQ ID NO: 1952 - protein, 20 aa, Corononavirus-HKU1
GRKDLFIMFRFRLNNLKWVV

SEQ ID NO: 1953 - protein, 21 aa, Corononavirus-HKU1
LVHYKTYTTAYLFYKRKPKVK

SEQ ID NO: 1954 - protein, 12 aa, Corononavirus-HKU1
RNYKNHKVAYKA

SEQ ID NO: 1955 - protein, 11 aa, Corononavirus-HKU1
LLKKQQQRLKK

SEQ ID NO: 1956 - protein, 17 aa, Corononavirus-HKU1
DKIKLKLKSVLCTKQYH

SEQ ID NO: 1957 - protein, 34 aa, Corononavirus-HKU1
KINQPYLLSASARQTINSEADSTNLDTASETVLP

SEQ ID NO: 1958 - protein, 16 aa, Corononavirus-HKU1
VVKLVTTPKLLLWEIS

SEQ ID NO: 1959 - protein, 5 aa, Corononavirus-HKU1
LRNVK

SEQ ID NO: 1960 - protein, 17 aa, Corononavirus-HKU1
EANLPNLRHQTFKGTIQ

SEQ ID NO: 1961 - protein, 4 aa, Corononavirus-HKU1
PTIG

SEQ ID NO: 1962 - protein, 22 aa, Corononavirus-HKU1
LYFRHKSSRFVTPNSLITRECV

SEQ ID NO: 1963 - protein, 10 aa, Corononavirus-HKU1
LGLQTSINKV

SEQ ID NO: 1964 - protein, 12 aa, Corononavirus-HKU1
DLTRDSNHHEMF

SEQ ID NO: 1965 - protein, 16 aa, Corononavirus-HKU1
QNHDDHHTHHNNYDIY

SEQ ID NO: 1966 - protein, 11 aa, Corononavirus-HKU1
NMQNHNQYNNI

SEQ ID NO: 1967 - protein, 8 aa, Corononavirus-HKU1
KRAIQGIL

SEQ ID NO: 1968 - protein, 23 aa, Corononavirus-HKU1
MKKKLVAKHTKAILHTFHMYLYL

SEQ ID NO: 1969 - protein, 7 aa, Corononavirus-HKU1
YNYYSKT

SEQ ID NO: 1970 - protein, 10 aa, Corononavirus-HKU1
DSSHNTNLKK

SEQ ID NO: 1971 - protein, 7 aa, Corononavirus-HKU1
YEDLKSN

SEQ ID NO: 1972 - protein, 7 aa, Corononavirus-HKU1
AQWMFDF

SEQ ID NO: 1973 - protein, 24 aa, Corononavirus-HKU1
TNEITQIQNQTILVQNDSNKQEAL

SEQ ID NO: 1974 - protein, 5 aa, Corononavirus-HKU1
QNKYS

SEQ ID NO: 1975 - protein, 17 aa, Corononavirus-HKU1
KQHFYLKLVQDNSKNYQ

SEQ ID NO: 1976 - protein, 7 aa, Corononavirus-HKU1
TSNDHYV

SEQ ID NO: 1977 - protein, 4 aa, Corononavirus-HKU1
NTLV

SEQ ID NO: 1978 - protein, 18 aa, Corononavirus-HKU1
VQYLHHLIYTNQDLLKQF

SEQ ID NO: 1979 - protein, 21 aa, Corononavirus-HKU1
TTNHKEHFELMTKYDYHYHKN

SEQ ID NO: 1980 - protein, 6 aa, Corononavirus-HKU1
YEEIDF

SEQ ID NO: 1981 - protein, 12 aa, Corononavirus-HKU1
LKQHQILQEKYH

SEQ ID NO: 1982 - protein, 14 aa, Corononavirus-HKU1
AVERHKHLKQLNDH

SEQ ID NO: 1983 - protein, 22 aa, Corononavirus-HKU1
AYQSEPEPLKHRDEIKFLVKKN

SEQ ID NO: 1984 - protein, 5 aa, Corononavirus-HKU1
LHQIY

SEQ ID NO: 1985 - protein, 7 aa, Corononavirus-HKU1
IIAVTNY

SEQ ID NO: 1986 - protein, 4 aa, Corononavirus-HKU1
VLEH

SEQ ID NO: 1987 - protein, 5 aa, Corononavirus-HKU1
QHFVF

SEQ ID NO: 1988 - protein, 5 aa, Corononavirus-HKU1
QVQSW

SEQ ID NO: 1989 - protein, 4 aa, Corononavirus-HKU1
NHSE

SEQ ID NO: 1990 - protein, 5 aa, Corononavirus-HKU1
KEEHY

SEQ ID NO: 1991 - protein, 7 aa, Corononavirus-HKU1
LSTFDFY

SEQ ID NO: 1992 - protein, 4 aa, Corononavirus-HKU1
HPNH

SEQ ID NO: 1993 - protein, 5 aa, Corononavirus-HKU1
FYIVH

SEQ ID NO: 1994 - protein, 14 aa, Corononavirus-HKU1
EKMVCQLLLTMVET

SEQ ID NO: 1995 - protein, 13 aa, Corononavirus-HKU1
RLWCNQKFEIQTK

SEQ ID NO: 1996 - protein, 4 aa, Corononavirus-HKU1
EAKL

SEQ ID NO: 1997 - protein, 8 aa, Corononavirus-HKU1
RIVHKEDL

SEQ ID NO: 1998 - protein, 19 aa, Corononavirus-HKU1
FHYHQYNCYKLQQNQHLKV

SEQ ID NO: 1999 - protein, 26 aa, Corononavirus-HKU1
LCQTINLQKKNEKKNRSVDLNIQLGI

SEQ ID NO: 2000 - protein, 8 aa, Corononavirus-HKU1
YYQHQNAN

SEQ ID NO: 2001 - protein, 8 aa, Corononavirus-HKU1
EYQLHAIE

SEQ ID NO: 2002 - protein, 5 aa, Corononavirus-HKU1
YQVNH

SEQ ID NO: 2003 - protein, 6 aa, Corononavirus-HKU1
LHLKYY

SEQ ID NO: 2004 - protein, 18 aa, Corononavirus-HKU1
YYHKKCHTLTISHGKLHN

SEQ ID NO: 2005 - protein, 8 aa, Corononavirus-HKU1
NRQIKNNQ

SEQ ID NO: 2006 - protein, 6 aa, Corononavirus-HKU1
IPLDQL

SEQ ID NO: 2007 - protein, 12 aa, Corononavirus-HKU1
SHKDHPQTQYCH

SEQ ID NO: 2008 - protein, 4 aa, Corononavirus-HKU1
RVQK

SEQ ID NO: 2009 - protein, 46 aa, Corononavirus-HKU1
QNDKKQKYFYVYDAKRKKKVSYNQHKNHYPCEEHKKKQNNQLNYQH

SEQ ID NO: 2010 - protein, 12 aa, Corononavirus-HKU1
KRNQDNYQNMAE

SEQ ID NO: 2011 - protein, 43 aa, Corononavirus-HKU1
LKKYYSKHSYILNYDKVKPKRKHFDEKQQKLFLHNKGKYYMFY

SEQ ID NO: 2012 - protein, 17 aa, Corononavirus-HKU1
NHTKDFANYYNKQQKLL

SEQ ID NO: 2013 - protein, 5 aa, Corononavirus-HKU1
KYLVL

SEQ ID NO: 2014 - protein, 11 aa, Corononavirus-HKU1
YHKGRNQHKHQ

SEQ ID NO: 2015 - protein, 4 aa, Corononavirus-HKU1
KLQY

SEQ ID NO: 2016 - protein, 5 aa, Corononavirus-HKU1
AAINH

SEQ ID NO: 2017 - protein, 6 aa, Corononavirus-HKU1
NKWYHY

SEQ ID NO: 2018 - protein, 4 aa, Corononavirus-HKU1
YHLK

SEQ ID NO: 2019 - protein, 8 aa, Corononavirus-HKU1
KKYYNGCY

SEQ ID NO: 2020 - protein, 52 aa, Corononavirus-HKU1
RKCHKTNLERHQYYKDKKHYMIHPIHHTFLHQHRTLHNVHQHQPETFFENKT

SEQ ID NO: 2021 - protein, 5 aa, Corononavirus-HKU1
GHKQL

SEQ ID NO: 2022 - protein, 16 aa, Corononavirus-HKU1
DQVNKNTYTSQCGRVQ

SEQ ID NO: 2023 - protein, 7 aa, Corononavirus-HKU1
YSHKNDN

SEQ ID NO: 2024 - protein, 18 aa, Corononavirus-HKU1
DRKQKVVYDSCNLKQKKV

SEQ ID NO: 2025 - protein, 7 aa, Corononavirus-HKU1
HKDKKYY

SEQ ID NO: 2026 - protein, 15 aa, Corononavirus-HKU1
QKNNNVSKQHYESSN

SEQ ID NO: 2027 - protein, 13 aa, Corononavirus-HKU1
NHTFYSKKKDYNY

SEQ ID NO: 2028 - protein, 11 aa, Corononavirus-HKU1
LQANYNTIDKN

SEQ ID NO: 2029 - protein, 5 aa, Corononavirus-HKU1
CQFYN

SEQ ID NO: 2030 - protein, 28 aa, Corononavirus-HKU1
KIAENQNCPTANQIVWSWVWQIYLKQYS

SEQ ID NO: 2031 - protein, 6 aa, Corononavirus-HKU1
NNYHIS

SEQ ID NO: 2032 - protein, 21 aa, Corononavirus-HKU1
IHQNYYKKKNQYELNEAKYSN

SEQ ID NO: 2033 - protein, 7 aa, Corononavirus-HKU1
KKFYVPN

SEQ ID NO: 2034 - protein, 5 aa, Corononavirus-HKU1
EVRVH

SEQ ID NO: 2035 - protein, 21 aa, Corononavirus-HKU1
AIYQCHNQVNQEYDDVQLQQA

SEQ ID NO: 2036 - protein, 9 aa, Corononavirus-HKU1
NQISHKHQY

SEQ ID NO: 2037 - protein, 4 aa, Corononavirus-HKU1
VIKI

SEQ ID NO: 2038 - protein, 6 aa, Corononavirus-HKU1
FYIESR

SEQ ID NO: 2039 - protein, 5 aa, Corononavirus-HKU1
NNQQH

SEQ ID NO: 2040 - protein, 6 aa, Corononavirus-HKU1
HHGCQI

SEQ ID NO: 2041 - protein, 5 aa, Corononavirus-HKU1
EDIGV

SEQ ID NO: 2042 - protein, 10 aa, Corononavirus-HKU1
PNIVKSHYQY

SEQ ID NO: 2043 - protein, 19 aa, Corononavirus-HKU1
HYKSKAKHNNEIKEYQDTN

SEQ ID NO: 2044 - protein, 24 aa, Corononavirus-HKU1
ACQNQHNKHKKCHVLDKNENTTNL

SEQ ID NO: 2045 - protein, 4 aa, Corononavirus-HKU1
KHYK

SEQ ID NO: 2046 - protein, 19 aa, Corononavirus-HKU1
TDTKVQIYQNAKIHYENYL

SEQ ID NO: 2047 - protein, 6 aa, Corononavirus-HKU1
YEDTHT

SEQ ID NO: 2048 - protein, 5 aa, Corononavirus-HKU1
CIDKL

SEQ ID NO: 2049 - protein, 11 aa, Corononavirus-HKU1
SPKHHYEVEQQ

SEQ ID NO: 2050 - protein, 4 aa, Corononavirus-HKU1
YKSC

SEQ ID NO: 2051 - protein, 4 aa, Corononavirus-HKU1
KHYL

SEQ ID NO: 2052 - protein, 7 aa, Corononavirus-HKU1
THYTKFY

SEQ ID NO: 2053 - protein, 5 aa, Corononavirus-HKU1
KKYHY

SEQ ID NO: 2054 - protein, 15 aa, Corononavirus-HKU1
NQIKRVSDTKEYSNM

SEQ ID NO: 2055 - protein, 7 aa, Corononavirus-HKU1
YLLKIDP

SEQ ID NO: 2056 - protein, 5 aa, Corononavirus-HKU1
NWHQI

SEQ ID NO: 2057 - protein, 4 aa, Corononavirus-HKU1
GNNQ

SEQ ID NO: 2058 - protein, 33 aa, Corononavirus-HKU1
YLNKHDQVYNMYPNHKKHPQHTHLCEELWCLNH

SEQ ID NO: 2059 - protein, 4 aa, Corononavirus-HKU1
QLML

SEQ ID NO: 2060 - protein, 13 aa, Corononavirus-HKU1
LITCLDLMRFIVI

SEQ ID NO: 2061 - protein, 5 aa, Corononavirus-HKU1
KNNKK

SEQ ID NO: 2062 - protein, 35 aa, Corononavirus-HKU1
NNRQKIINTNWMFNNRRCRTPTKRIIGPNGCKIII

SEQ ID NO: 2063 - protein, 5 aa, Corononavirus-HKU1
KYTII

SEQ ID NO: 2064 - protein, 6 aa, Corononavirus-HKU1
NTRNII

SEQ ID NO: 2065 - protein, 34 aa, Corononavirus-HKU1
NRNKTTITVVNIILANIISRRIAKITIWQLTCNR

SEQ ID NO: 2066 - protein, 28 aa, Corononavirus-HKU1
GTLVVPSRINNLYRYKLFRFIKTESFSR

SEQ ID NO: 2067 - protein, 20 aa, Corononavirus-HKU1
KRCSGGNFIRTWFKRNINTV

SEQ ID NO: 2068 - protein, 32 aa, Corononavirus-HKU1
IRINNIRKTINRASIYVIIVLTKVRFKKAKRY

SEQ ID NO: 2069 - protein, 5 aa, Corononavirus-HKU1
IKRTT

SEQ ID NO: 2070 - protein, 16 aa, Corononavirus-HKU1
SKINFLRIINKNRIVK

SEQ ID NO: 2071 - protein, 31 aa, Corononavirus-HKU1
NITFTRIKLRKRNIIRNINKSKITKKGHIRI

SEQ ID NO: 2072 - protein, 61 aa, Corononavirus-HKU1
GTIKSYLVKKPYIITTIRKTLKSMIRIKINTLIKNNLITFASVIIKSSEMKTLKNRITGTR

SEQ ID NO: 2073 - protein, 20 aa, Corononavirus-HKU1
NLTIVAQTRVNIQIIKIFNF

SEQ ID NO: 2074 - protein, 13 aa, Corononavirus-HKU1
IINMVTIRTTITK

SEQ ID NO: 2075 - protein, 5 aa, Corononavirus-HKU1
KPVMV

SEQ ID NO: 2076 - protein, 17 aa, Corononavirus-HKU1
MRHNIKRFIKTITEIKK

SEQ ID NO: 2077 - protein, 33 aa, Corononavirus-HKU1
HSLDLMRSNKYLQDYHQQKSLYAYRELIIYLFQ

SEQ ID NO: 2078 - protein, 13 aa, Corononavirus-HKU1
ENKLNHLIDLVLN

SEQ ID NO: 2079 - protein, 11 aa, Corononavirus-HKU1
QQQCQPISKKI

SEQ ID NO: 2080 - protein, 21 aa, Corononavirus-HKU1
SYQINYKHRHSMLYYFSKTNS

SEQ ID NO: 2081 - protein, 21 aa, Corononavirus-HKU1
HCHLFQKKIYPGNLYLLKTLH

SEQ ID NO: 2082 - protein, 5 aa, Corononavirus-HKU1
KKHLH

SEQ ID NO: 2083 - protein, 23 aa, Corononavirus-HKU1
YKKLSKMQNNSLIYINQHSKKTL

SEQ ID NO: 2084 - protein, 17 aa, Corononavirus-HKU1
LHYHPKIIYHELNDKCK

SEQ ID NO: 2085 - protein, 13 aa, Corononavirus-HKU1
KTHPYSHYNHQYF

SEQ ID NO: 2086 - protein, 25 aa, Corononavirus-HKU1
EDHTYQILSNPNDNQMVKSYNLQNK

SEQ ID NO: 2087 - protein, 4 aa, Corononavirus-HKU1
LNYR

SEQ ID NO: 2088 - protein, 40 aa, Corononavirus-HKU1
QMGLNHYLQEYYQMVTTVLKQQNLELLLYQTLHLNVKHAY

SEQ ID NO: 2089 - protein, 6 aa, Corononavirus-HKU1
QEQLML

SEQ ID NO: 2090 - protein, 10 aa, Corononavirus-HKU1
YSNTDIIECT

SEQ ID NO: 2091 - protein, 7 aa, Corononavirus-HKU1
QHSSYSL

SEQ ID NO: 2092 - protein, 22 aa, Corononavirus-HKU1
VYHNSIKRLSLMEHSNTYTKQA

SEQ ID NO: 2093 - protein, 7 aa, Corononavirus-HKU1
NSQVSNH

SEQ ID NO: 2094 - protein, 4 aa, Corononavirus-HKU1
WLAF

SEQ ID NO: 2095 - protein, 4 aa, Corononavirus-HKU1
DKKS

SEQ ID NO: 2096 - protein, 8 aa, Corononavirus-HKU1
FYYHYTTT

SEQ ID NO: 2097 - protein, 4 aa, Corononavirus-HKU1
IENP

SEQ ID NO: 2098 - protein, 7 aa, Corononavirus-HKU1
HNSNLMT

SEQ ID NO: 2099 - protein, 9 aa, Corononavirus-HKU1
KQNHLIINQ

SEQ ID NO: 2100 - protein, 13 aa, Corononavirus-HKU1
LYKHSYYYHTPDQ

SEQ ID NO: 2101 - protein, 5 aa, Corononavirus-HKU1
NMNEY

SEQ ID NO: 2102 - protein, 11 aa, Corononavirus-HKU1
NHTVKTLELTN

SEQ ID NO: 2103 - protein, 9 aa, Corononavirus-HKU1
IFFSYEISL

SEQ ID NO: 2104 - protein, 6 aa, Corononavirus-HKU1
ANANLL

SEQ ID NO: 2105 - protein, 16 aa, Corononavirus-HKU1
NYHKLYDQMHSLLNHI

SEQ ID NO: 2106 - protein, 7 aa, Corononavirus-HKU1
TDYHPYQ

SEQ ID NO: 2107 - protein, 18 aa, Corononavirus-HKU1
NPVLNLSEVQNLTIHDSE

SEQ ID NO: 2108 - protein, 8 aa, Corononavirus-HKU1
NVLEHHYQ

SEQ ID NO: 2109 - protein, 25 aa, Corononavirus-HKU1
HYPRNYHLDYLVGSSNGLSIGCLFG

SEQ ID NO: 2110 - protein, 7 aa, Corononavirus-HKU1
HRHHLFS

SEQ ID NO: 2111 - protein, 6 aa, Corononavirus-HKU1
RTKTQL

SEQ ID NO: 2112 - protein, 18 aa, Corononavirus-HKU1
VLQLYPQSHHLNQLVADL

SEQ ID NO: 2113 - protein, 10 aa, Corononavirus-HKU1
SLITYLIFQY

SEQ ID NO: 2114 - protein, 7 aa, Corononavirus-HKU1
KHHFLLF

SEQ ID NO: 2115 - protein, 18 aa, Corononavirus-HKU1
KLLKRQCHDHQKVYSNFR

SEQ ID NO: 2116 - protein, 19 aa, Corononavirus-HKU1
TSNLCIYKHHKWNYKTNYL

SEQ ID NO: 2117 - protein, 16 aa, Corononavirus-HKU1
HNPTGHASNKYQCSNF

SEQ ID NO: 2118 - protein, 10 aa, Corononavirus-HKU1
VQGGAGYYVL

SEQ ID NO: 2119 - protein, 6 aa, Corononavirus-HKU1
TIQQLY

SEQ ID NO: 2120 - protein, 6 aa, Corononavirus-HKU1
EMMYYF

SEQ ID NO: 2121 - protein, 5 aa, Corononavirus-HKU1
QYLHY

SEQ ID NO: 2122 - protein, 6 aa, Corononavirus-HKU1
QQLCHS

SEQ ID NO: 2123 - protein, 14 aa, Corononavirus-HKU1
HKVIHLYVHHNDQH

SEQ ID NO: 2124 - protein, 12 aa, Corononavirus-HKU1
PSYILRFLNSVT

SEQ ID NO: 2125 - protein, 16 aa, Corononavirus-HKU1
KCSINYKNQNSYKPKK

SEQ ID NO: 2126 - protein, 26 aa, Corononavirus-HKU1
LYYKTQGSYNILQHALNKQLHLDYTV

SEQ ID NO: 2127 - protein, 13 aa, Corononavirus-HKU1
YKWRFLKERNQLV

SEQ ID NO: 2128 - protein, 18 aa, Corononavirus-HKU1
ILNHLRTHKAYLNNRKKA

SEQ ID NO: 2129 - protein, 6 aa, Corononavirus-HKU1
DFQKQF

SEQ ID NO: 2130 - protein, 6 aa, Corononavirus-HKU1
YGMHVY

SEQ ID NO: 2131 - protein, 26 aa, Corononavirus-HKU1
HTNYHHYIQEGLIYLTLECQIYKQLN

SEQ ID NO: 2132 - protein, 16 aa, Corononavirus-HKU1
MDIYQHYNSKTYINHL

SEQ ID NO: 2133 - protein, 13 aa, Corononavirus-HKU1
NYLYAHHRHKITV

SEQ ID NO: 2134 - protein, 11 aa, Corononavirus-HKU1
QTWLQEKHHKI

SEQ ID NO: 2135 - protein, 4 aa, Corononavirus-HKU1
IHNL

SEQ ID NO: 2136 - protein, 5 aa, Corononavirus-HKU1
HKLNL

SEQ ID NO: 2137 - protein, 17 aa, Corononavirus-HKU1
DCLCHNISCIYYIAWQL

SEQ ID NO: 2138 - protein, 11 aa, Corononavirus-HKU1
HAAITYKMYLY

SEQ ID NO: 2139 - protein, 9 aa, Corononavirus-HKU1
KLLDTLNSN

SEQ ID NO: 2140 - protein, 14 aa, Corononavirus-HKU1
QIYKNNHRLLNNES

SEQ ID NO: 2141 - protein, 20 aa, Corononavirus-HKU1
LHQLTQHVHLYVHYKLYRDY

SEQ ID NO: 2142 - protein, 13 aa, Corononavirus-HKU1
LKNLYNPTVVYLQ

SEQ ID NO: 2143 - protein, 20 aa, Corononavirus-HKU1
VDYTHNHKYNYGANNHNNQF

SEQ ID NO: 2144 - protein, 4 aa, Corononavirus-HKU1
NCSM

SEQ ID NO: 2145 - protein, 5 aa, Corononavirus-HKU1
NTHYN

SEQ ID NO: 2146 - protein, 5 aa, Corononavirus-HKU1
ALCLI

SEQ ID NO: 2147 - protein, 6 aa, Corononavirus-HKU1
QNTLNK

SEQ ID NO: 2148 - protein, 7 aa, Corononavirus-HKU1
VQNWQTK

SEQ ID NO: 2149 - protein, 18 aa, Corononavirus-HKU1
ILHYQKGLKDNQITFEQF

SEQ ID NO: 2150 - protein, 9 aa, Corononavirus-HKU1
QYPTFDLLT

SEQ ID NO: 2151 - protein, 5 aa, Corononavirus-HKU1
GVLNV

SEQ ID NO: 2152 - protein, 7 aa, Corononavirus-HKU1
IFHQEEL

SEQ ID NO: 2153 - protein, 4 aa, Corononavirus-HKU1
LQFF

SEQ ID NO: 2154 - protein, 11 aa, Corononavirus-HKU1
KYNNLSQQISQ

SEQ ID NO: 2155 - protein, 24 aa, Corononavirus-HKU1
LQLQNPHQLKNLFAVESLFQCFRE

SEQ ID NO: 2156 - protein, 12 aa, Corononavirus-HKU1
HERPQHQNQPNL

SEQ ID NO: 2157 - protein, 4 aa, Corononavirus-HKU1
WLHL

SEQ ID NO: 2158 - protein, 9 aa, Corononavirus-HKU1
NNHQESNLI

SEQ ID NO: 2159 - protein, 22 aa, Corononavirus-HKU1
EILNENMLKQVHKYLNLQPNFH

SEQ ID NO: 2160 - protein, 26 aa, Corononavirus-HKU1
PYIYHQLLKMRGHALDDNLSNFYYNL

SEQ ID NO: 2161 - protein, 18 aa, Corononavirus-HKU1
LCNANEVKFDFEFYLKVE

SEQ ID NO: 2162 - protein, 9 aa, Corononavirus-HKU1
EIQIIAYYS

SEQ ID NO: 2163 - protein, 8 aa, Corononavirus-HKU1
HKKCPSWL

SEQ ID NO: 2164 - protein, 4 aa, Corononavirus-HKU1
LWQH

SEQ ID NO: 2165 - protein, 11 aa, Corononavirus-HKU1
QNGLFLLFVNI

SEQ ID NO: 2166 - protein, 21 aa, Corononavirus-HKU1
HNHIPNLEQNLQFVFEHLKHA

SEQ ID NO: 2167 - protein, 9 aa, Corononavirus-HKU1
QHNSDYYKD

SEQ ID NO: 2168 - protein, 8 aa, Corononavirus-HKU1
KQHYSKLD

SEQ ID NO: 2169 - protein, 5 aa, Corononavirus-HKU1
LLKIY

SEQ ID NO: 2170 - protein, 19 aa, Corononavirus-HKU1
LDISVEYLQHLNSHVLSVP

SEQ ID NO: 2171 - protein, 8 aa, Corononavirus-HKU1
NIMNYYHF

SEQ ID NO: 2172 - protein, 15 aa, Corononavirus-HKU1
VYYHKPMLKQFLQFL

SEQ ID NO: 2173 - protein, 18 aa, Corononavirus-HKU1
DTYNNFPKRYQDLNNTLF

SEQ ID NO: 2174 - protein, 25 aa, Corononavirus-HKU1
VLKNPCSTAHVVQVIEQDLQYIHNV

SEQ ID NO: 2175 - protein, 4 aa, Corononavirus-HKU1
YEHL

SEQ ID NO: 2176 - protein, 5 aa, Corononavirus-HKU1
QTIHN

SEQ ID NO: 2177 - protein, 8 aa, Corononavirus-HKU1
LHQQQQYL

SEQ ID NO: 2178 - protein, 9 aa, Corononavirus-HKU1
PTLVMHLLW

SEQ ID NO: 2179 - protein, 8 aa, Corononavirus-HKU1
KHTYKWYH

SEQ ID NO: 2180 - protein, 9 aa, Corononavirus-HKU1
TYHNNLHEL

SEQ ID NO: 2181 - protein, 5 aa, Corononavirus-HKU1
YVYNR

SEQ ID NO: 2182 - protein, 17 aa, Corononavirus-HKU1
YLKTYKLFHTMHLQQHD

SEQ ID NO: 2183 - protein, 16 aa, Corononavirus-HKU1
QQYKLHVLCSNKQLDL

SEQ ID NO: 2184 - protein, 24 aa, Corononavirus-HKU1
QDETFPYQGDLEQCNNVSFQCADN

SEQ ID NO: 2185 - protein, 13 aa, Corononavirus-HKU1
QHYFETPMEHYKH

SEQ ID NO: 2186 - protein, 4 aa, Corononavirus-HKU1
KILY

SEQ ID NO: 2187 - protein, 8 aa, Corononavirus-HKU1
HSSLVGQV

SEQ ID NO: 2188 - protein, 4 aa, Corononavirus-HKU1
VHLN

SEQ ID NO: 2189 - protein, 12 aa, Corononavirus-HKU1
LQNVMLKQKHHL

SEQ ID NO: 2190 - protein, 4 aa, Corononavirus-HKU1
KVYK

SEQ ID NO: 2191 - protein, 6 aa, Corononavirus-HKU1
RGNTHR

SEQ ID NO: 2192 - protein, 17 aa, Corononavirus-HKU1
LIHFYQKHTHLKLSYQY

SEQ ID NO: 2193 - protein, 4 aa, Corononavirus-HKU1
NGSL

SEQ ID NO: 2194 - protein, 5 aa, Corononavirus-HKU1
KHNFY

SEQ ID NO: 2195 - protein, 8 aa, Corononavirus-HKU1
LYLSPNTK

SEQ ID NO: 2196 - protein, 4 aa, Corononavirus-HKU1
LLYH

SEQ ID NO: 2197 - protein, 5 aa, Corononavirus-HKU1
QSLEW

SEQ ID NO: 2198 - protein, 6 aa, Corononavirus-HKU1
QKHSFV

SEQ ID NO: 2199 - protein, 34 aa, Corononavirus-HKU1
KPLQLPFEFLQQITLNVQYTHLPEHNHQLLSIYN

SEQ ID NO: 2200 - protein, 21 aa, Corononavirus-HKU1
NHLYKVNPCKIVYTNQRPYHS

SEQ ID NO: 2201 - protein, 20 aa, Corononavirus-HKU1
MNNGVYGFHNSKTYRPNIIW

SEQ ID NO: 2202 - protein, 6 aa, Corononavirus-HKU1
HHSHHS

SEQ ID NO: 2203 - protein, 15 aa, Corononavirus-HKU1
VHYKRKVRHSKHIYD

SEQ ID NO: 2204 - protein, 50 aa, Corononavirus-HKU1
HGHNNIYNITKAYVYNCHNAKKFVMNKQRMHLHSASRHFLNTYSCKMILQ

SEQ ID NO: 2205 - protein, 9 aa, Corononavirus-HKU1
TLNHHKYLK

SEQ ID NO: 2206 - protein, 41 aa, Corononavirus-HKU1
HYNYLRSEYQDHYTVFLYILNIHERLFGILHFHDVLKGKHL

SEQ ID NO: 2207 - protein, 27 aa, Corononavirus-HKU1
LDLQSALSKEHCQSSINHQQNNQLLKF

SEQ ID NO: 2208 - protein, 14 aa, Corononavirus-HKU1
KDLDMVNKHNHHLS

SEQ ID NO: 2209 - protein, 10 aa, Corononavirus-HKU1
YVGNKIHEDH

SEQ ID NO: 2210 - protein, 7 aa, Corononavirus-HKU1
YHFQPNI

SEQ ID NO: 2211 - protein, 15 aa, Corononavirus-HKU1
RHYSDSTKLVEKHLY

SEQ ID NO: 2212 - protein, 5 aa, Corononavirus-HKU1
LYNPY

SEQ ID NO: 2213 - protein, 17 aa, Corononavirus-HKU1
HNQSYNRQHHHHSKSSY

SEQ ID NO: 2214 - protein, 10 aa, Corononavirus-HKU1
NAYIKIHNTH

SEQ ID NO: 2215 - protein, 12 aa, Corononavirus-HKU1
QMYNQHNLYDKH

SEQ ID NO: 2216 - protein, 21 aa, Corononavirus-HKU1
SISVFVNCVYLNLQSYGHYRP

SEQ ID NO: 2217 - protein, 4 aa, Corononavirus-HKU1
ENKH

SEQ ID NO: 2218 - protein, 5 aa, Corononavirus-HKU1
QPDIY

SEQ ID NO: 2219 - protein, 5 aa, Corononavirus-HKU1
LHHHC

SEQ ID NO: 2220 - protein, 4 aa, Corononavirus-HKU1
YHQA

SEQ ID NO: 2221 - protein, 7 aa, Corononavirus-HKU1
HNSNRHT

SEQ ID NO: 2222 - protein, 33 aa, Corononavirus-HKU1
LFHSKLEHIHSQGDKIYHHVNNKIHVCGPKLNY

SEQ ID NO: 2223 - protein, 7 aa, Corononavirus-HKU1
QYAKYLA

SEQ ID NO: 2224 - protein, 4 aa, Corononavirus-HKU1
HDHI

SEQ ID NO: 2225 - protein, 5 aa, Corononavirus-HKU1
DNPNP

SEQ ID NO: 2226 - protein, 8 aa, Corononavirus-HKU1
EQGCQHPL

SEQ ID NO: 2227 - protein, 12 aa, Corononavirus-HKU1
DDVTYRPNHHKI

SEQ ID NO: 2228 - protein, 6 aa, Corononavirus-HKU1
QQEHLG

SEQ ID NO: 2229 - protein, 15 aa, Corononavirus-HKU1
LLYSSNIFDGTFGLS

SEQ ID NO: 2230 - protein, 10 aa, Corononavirus-HKU1
KHLLQCELYS

SEQ ID NO: 2231 - protein, 15 aa, Corononavirus-HKU1
HILNSFELRWAEHYV

SEQ ID NO: 2232 - protein, 24 aa, Corononavirus-HKU1
YMHKFHSVPQMIMPHNKVWLYQIY

SEQ ID NO: 2233 - protein, 10 aa, Corononavirus-HKU1
MDNQHFYHNY

SEQ ID NO: 2234 - protein, 26 aa, Corononavirus-HKU1
LVMLVYNHHHKFQNIYKQLLIQTITA

SEQ ID NO: 2235 - protein, 10 aa, Corononavirus-HKU1
VNYTYNNYNQ

SEQ ID NO: 2236 - protein, 7 aa, Corononavirus-HKU1
LQHYHLE

SEQ ID NO: 2237 - protein, 12 aa, Corononavirus-HKU1
RKNVSNQLYYPL

SEQ ID NO: 2238 - protein, 5 aa, Corononavirus-HKU1
TSLYF

SEQ ID NO: 2239 - protein, 7 aa, Corononavirus-HKU1
QTRKSLG

SEQ ID NO: 2240 - protein, 13 aa, Corononavirus-HKU1
SYLVLQFEILYHL

SEQ ID NO: 2241 - protein, 4 aa, Corononavirus-HKU1
WQLH

SEQ ID NO: 2242 - protein, 10 aa, Corononavirus-HKU1
NNKFVNQAEH

SEQ ID NO: 2243 - protein, 5 aa, Corononavirus-HKU1
QMQRA

SEQ ID NO: 2244 - protein, 10 aa, Corononavirus-HKU1
QDLLHKEVNL

SEQ ID NO: 2245 - protein, 13 aa, Corononavirus-HKU1
ETNDNGVCQHLSS

SEQ ID NO: 2246 - protein, 10 aa, Corononavirus-HKU1
LHLTLCNGNQ

SEQ ID NO: 2247 - protein, 12 aa, Corononavirus-HKU1
KQQTVHHLQKFV

SEQ ID NO: 2248 - protein, 7 aa, Corononavirus-HKU1
QGDQNKY

SEQ ID NO: 2249 - protein, 4 aa, Corononavirus-HKU1
VKPY

SEQ ID NO: 2250 - protein, 10 aa, Corononavirus-HKU1
YTYHYHNPQY

SEQ ID NO: 2251 - protein, 8 aa, Corononavirus-HKU1
DDTSYPNT

SEQ ID NO: 2252 - protein, 7 aa, Corononavirus-HKU1
TTLTCNQ

SEQ ID NO: 2253 - protein, 13 aa, Corononavirus-HKU1
NHTVQDRIVYNYH

SEQ ID NO: 2254 - protein, 10 aa, Corononavirus-HKU1
QIIHNLIHDT

SEQ ID NO: 2255 - protein, 20 aa, Corononavirus-HKU1
ASYKNSKNLQLPHQTLGLFV

SEQ ID NO: 2256 - protein, 31 aa, Corononavirus-HKU1
NHQNHTIDHTNLGYLKLKHQLNLLQLRCLQK

SEQ ID NO: 2257 - protein, 4 aa, Corononavirus-HKU1
VKLY

SEQ ID NO: 2258 - protein, 7 aa, Corononavirus-HKU1
GLIFYIY

SEQ ID NO: 2259 - protein, 12 aa, Corononavirus-HKU1
YQDFQQNHTNLS

SEQ ID NO: 2260 - protein, 34 aa, Corononavirus-HKU1
KSRILYNQHTHKEFHTILNNHYDQNDAMHSKDLT

SEQ ID NO: 2261 - protein, 20 aa, Corononavirus-HKU1
YTLKDSYELYVARDYHQYQM

SEQ ID NO: 2262 - protein, 11 aa, Corononavirus-HKU1
RNHVQPQHHNF

SEQ ID NO: 2263 - protein, 14 aa, Corononavirus-HKU1
STHNKFSLYYKLLN

SEQ ID NO: 2264 - protein, 44 aa, Corononavirus-HKU1
QQRTYPIYYRRHLYAENGNNSLYNINLYQLYWYYKCQMPLIEHQ

SEQ ID NO: 2265 - protein, 9 aa, Corononavirus-HKU1
HRVLAGHSH

SEQ ID NO: 2266 - protein, 5 aa, Corononavirus-HKU1
YPEPV

SEQ ID NO: 2267 - protein, 8 aa, Corononavirus-HKU1
IFRLNSDT

SEQ ID NO: 2268 - protein, 20 aa, Corononavirus-HKU1
TYTGTTAISPKTTDLTNIMC

SEQ ID NO: 2269 - protein, 18 aa, Corononavirus-HKU1
HIKNRIFYTQRDLYKFTT

SEQ ID NO: 2270 - protein, 19 aa, Corononavirus-HKU1
FTYTIYIWMLYTCTAINTN

SEQ ID NO: 2271 - protein, 43 aa, Corononavirus-HKU1
GTTIRILVNSSLRFNSNGHTSTSMITEHFNTINYRYTTLLYII

SEQ ID NO: 2272 - protein, 11 aa, Corononavirus-HKU1
ISFLRIYRKCT

SEQ ID NO: 2273 - protein, 19 aa, Corononavirus-HKU1
KYRRISCILSSNTSLQSNC

SEQ ID NO: 2274 - protein, 8 aa, Corononavirus-HKU1
STNNPPSS

SEQ ID NO: 2275 - protein, 29 aa, Corononavirus-HKU1
SVTSFNKIKILNFKSLNILYRKFTRRIKL

SEQ ID NO: 2276 - protein, 54 aa, Corononavirus-HKU1
NNTISIIFHYLSILKTINITKNSINYSTTTTIIIITLSRNITIHIRTTINNLYF

SEQ ID NO: 2277 - protein, 35 aa, Corononavirus-HKU1
FMRHQLIILHNSISNFIIPVRNDNKRPIRINTNIS

SEQ ID NO: 2278 - protein, 40 aa, Corononavirus-HKU1
LFINTISILNSLYMPYTTSICNINIINNFIKNLFIWYYYS

SEQ ID NO: 2279 - protein, 24 aa, Corononavirus-HKU1
SISSQCWNSTQRYTTFNSIIQNRI

SEQ ID NO: 2280 - protein, 37 aa, Corononavirus-HKU1
SLIIQFTNHAKKHCLQSGNNFTLLIINPSLFIHVSKC

SEQ ID NO: 2281 - protein, 26 aa, Corononavirus-HKU1
VCHTFKFASYSFITFIHRLSYITCFF

SEQ ID NO: 2282 - protein, 68 aa, Corononavirus-HKU1
LFYLLLINRTTIFSISQIFLCDFIFNKTSHIYKLTLQSLQNGTILNIIIANFIYTCKTLSINCSRIGE

SEQ ID NO: 2283 - protein, 11 aa, Corononavirus-HKU1
LSKLIKSYTQI

SEQ ID NO: 2284 - protein, 4 aa, Corononavirus-HKU1
YFIM

SEQ ID NO: 2285 - protein, 17 aa, Corononavirus-HKU1
NTTILPQLRIRSNMQML

SEQ ID NO: 2286 - protein, 12 aa, Corononavirus-HKU1
QNNISTFHISQF

SEQ ID NO: 2287 - protein, 17 aa, Corononavirus-HKU1
LNLGDFNNWHATYSKQF

SEQ ID NO: 2288 - protein, 11 aa, Corononavirus-HKU1
QNSLKTITRWT

SEQ ID NO: 2289 - protein, 27 aa, Corononavirus-HKU1
AISIHITQFLNRNFIIINTHRHSKNTV

SEQ ID NO: 2290 - protein, 9 aa, Corononavirus-HKU1
KREKSPITR

SEQ ID NO: 2291 - protein, 5 aa, Corononavirus-HKU1
NIPYK

SEQ ID NO: 2292 - protein, 30 aa, Corononavirus-HKU1
VTQENQFNIRYICKIKYINRQPISNNFCYS

SEQ ID NO: 2293 - protein, 9 aa, Corononavirus-HKU1
QNSGPCIST

SEQ ID NO: 2294 - protein, 5 aa, Corononavirus-HKU1
KGCNK

SEQ ID NO: 2295 - protein, 5 aa, Corononavirus-HKU1
QNILF

SEQ ID NO: 2296 - protein, 9 aa, Corononavirus-HKU1
IRPKIPHRN

SEQ ID NO: 2297 - protein, 28 aa, Corononavirus-HKU1
SNYSTNQKHQRKNVMINTMHSYKNSKNT

SEQ ID NO: 2298 - protein, 19 aa, Corononavirus-HKU1
NTTIKYFINISKIHSRNKI

SEQ ID NO: 2299 - protein, 15 aa, Corononavirus-HKU1
EPDISKTSKTFLINN

SEQ ID NO: 2300 - protein, 24 aa, Corononavirus-HKU1
IIYIKQGTEYRNYIHSQIKMLMFN

SEQ ID NO: 2301 - protein, 10 aa, Corononavirus-HKU1
HHKTNKTKYT

SEQ ID NO: 2302 - protein, 69 aa, Corononavirus-HKU1
CNTNHMCINIHKYSPFNKCRNYTTKQKCRYQNPINCFFNKSFCFRLQFNTSQLLINVRRCQFIFKSTTS

SEQ ID NO: 2303 - protein, 9 aa, Corononavirus-HKU1
YLTTLKSHI

SEQ ID NO: 2304 - protein, 6 aa, Corononavirus-HKU1
TLNSSQ

SEQ ID NO: 2305 - protein, 8 aa, Corononavirus-HKU1
SFNRNTCH

SEQ ID NO: 2306 - protein, 4 aa, Corononavirus-HKU1
SQSI

SEQ ID NO: 2307 - protein, 82 aa, Corononavirus-HKU1
DKICFYLAKTICHSPNIKIFSRTNIILYKPSTIIKYSCIEPSNNINSLDVVLNWQLYNLSISIWTIKITSKISASVTTSTEL

SEQ ID NO: 2308 - protein, 12 aa, Corononavirus-HKU1
LMHIYKLNTITC

SEQ ID NO: 2309 - protein, 7 aa, Corononavirus-HKU1
YITNRST

SEQ ID NO: 2310 - protein, 28 aa, Corononavirus-HKU1
PTQKRTFNSITTTHSNMKCPLWSAIIRS

SEQ ID NO: 2311 - protein, 21 aa, Corononavirus-HKU1
NSKSFTRFNITKSIFWSVRIL

SEQ ID NO: 2312 - protein, 17 aa, Corononavirus-HKU1
RDCQNKLTALHLVRHNC

SEQ ID NO: 2313 - protein, 11 aa, Corononavirus-HKU1
THPTRHYSKIT

SEQ ID NO: 2314 - protein, 5 aa, Corononavirus-HKU1
SNSTQ

SEQ ID NO: 2315 - protein, 11 aa, Corononavirus-HKU1
GRIIRFVHIRG

SEQ ID NO: 2316 - protein, 12 aa, Corononavirus-HKU1
TYNMTRTINFVI

SEQ ID NO: 2317 - protein, 18 aa, Corononavirus-HKU1
TIQSHTTISNTNNTRFNF

SEQ ID NO: 2318 - protein, 9 aa, Corononavirus-HKU1
RRRYHLYNT

SEQ ID NO: 2319 - protein, 14 aa, Corononavirus-HKU1
LQKRCRNRCCRRLV

SEQ ID NO: 2320 - protein, 15 aa, Corononavirus-HKU1
DIITIIVIKCFHSFS

SEQ ID NO: 2321 - protein, 38 aa, Corononavirus-HKU1
LRTRRFSIGSSIHFTTIVTILIIQTQISIVGNIRNRIL

SEQ ID NO: 2322 - protein, 32 aa, Corononavirus-HKU1
STIRIFSNHKSSKRCFFKCTITTYINTNFPTI

SEQ ID NO: 2323 - protein, 89 aa, Corononavirus-HKU1
NMVCNNHSYICDTKPKRHYSTIHNNPLQMHNYTNFRRKIQCYIKIKTSINTCTNRINLKNKKHKKINTPNNNIYNYNTSIISKSTLKFY

SEQ ID NO: 2324 - protein, 29 aa, Corononavirus-HKU1
IIKNQDNNYSQYSSKNRTSSKRKEIYRTN

SEQ ID NO: 2325 - protein, 99 aa, Corononavirus-HKU1
TTKKLIKQIKKISTTKSSRHTSIIIIIQNPGTIKIKTYTLFGVFTCTHSTISHRARSYNTYNTFTNNIRKSYKTIRISKAITCMWNQRCIQRSILHNTI

SEQ ID NO: 2326 - protein, 18 aa, Corononavirus-HKU1
ITIRMWCTITSFKHSTQR

SEQ ID NO: 2327 - protein, 29 aa, Corononavirus-HKU1
NTTTSIKIIIRNLNMWCIALNTITSKCIS

SEQ ID NO: 2328 - protein, 57 aa, Corononavirus-HKU1
NMKAMSQNFSRNIKHSRTDIFIHNCHYNRAIHRIMIVNRPKSGLIPLIKLEKFISKT

SEQ ID NO: 2329 - protein, 30 aa, Corononavirus-HKU1
NISNNTIINNFKTSISRQMNIRLINTICRQ

SEQ ID NO: 2330 - protein, 4 aa, Corononavirus-HKU1
YKTD

SEQ ID NO: 2331 - protein, 4 aa, Corononavirus-HKU1
TNKK

SEQ ID NO: 2332 - protein, 10 aa, Corononavirus-HKU1
QITQYNTSFK

SEQ ID NO: 2333 - protein, 18 aa, Corononavirus-HKU1
KGCCKNRDTCLLLIKSQF

SEQ ID NO: 2334 - protein, 10 aa, Corononavirus-HKU1
LQASFNTCFF

SEQ ID NO: 2335 - protein, 36 aa, Corononavirus-HKU1
ISSKLIKSINKPYTRNISCLSNITLYMLSTILYKNT

SEQ ID NO: 2336 - protein, 9 aa, Corononavirus-HKU1
ISSYNIITL

SEQ ID NO: 2337 - protein, 33 aa, Corononavirus-HKU1
ICRYQIVIIFISKFQTSSYCRYHRFSNKSCFNI

SEQ ID NO: 2338 - protein, 14 aa, Corononavirus-HKU1
INGTTFTYTSHKSI

SEQ ID NO: 2339 - protein, 49 aa, Corononavirus-HKU1
LHTLSKRSMSNVNKIIKTLSINIKMRHKSININIKHSLGYRDTITSCSN

SEQ ID NO: 2340 - protein, 5 aa, Corononavirus-HKU1
LFVYK

SEQ ID NO: 2341 - protein, 5 aa, Corononavirus-HKU1
YRPIQ

SEQ ID NO: 2342 - protein, 33 aa, Corononavirus-HKU1
LCIKHNSIQKISSISITLYYNYIQIRNNFNFRM

SEQ ID NO: 2343 - protein, 7 aa, Corononavirus-HKU1
QIINIYK

SEQ ID NO: 2344 - protein, 32 aa, Corononavirus-HKU1
TSINIIVNTLSISIIEQTHHTTNLLNISNYIM

SEQ ID NO: 2345 - protein, 76 aa, Corononavirus-HKU1
SISWIYRSFKLFRKFYSSFYSYKSVTWFKRMAIKTIPLMFNTKTSTTISSNIIITNYTTNNSTTLNTNTTISFITK

SEQ ID NO: 2346 - protein, 34 aa, Corononavirus-HKU1
TTSFITTIDNMPNKTNYFIHSSNNYIKPQQDKSR

SEQ ID NO: 2347 - protein, 16 aa, Corononavirus-HKU1
HISYKYNKSNQPMHSF

SEQ ID NO: 2348 - protein, 10 aa, Corononavirus-HKU1
HKQIRQPCSK

SEQ ID NO: 2349 - protein, 5 aa, Corononavirus-HKU1
TNKTK

SEQ ID NO: 2350 - protein, 7 aa, Corononavirus-HKU1
WIKPYCV

SEQ ID NO: 2351 - protein, 8 aa, Corononavirus-HKU1
ITNNEFNN

SEQ ID NO: 2352 - protein, 5 aa, Corononavirus-HKU1
TNIIK

SEQ ID NO: 2353 - protein, 42 aa, Corononavirus-HKU1
NTSIYFILNKIYSCICIQHIKTRMTQFTYKTTITKMTCKTYT

SEQ ID NO: 2354 - protein, 100 aa, Corononavirus-HKU1
LRIKITNCNQTKSSLYPHNNSSHKNRKNTNIRKIKVTKNNIYIQKIKPKQKHSGYNKKTFYKYTPSKCLKSIFKSQTKQIKSKLRSYFCSIKNGFIICKM

SEQ ID NO: 2355 - protein, 25 aa, Corononavirus-HKU1
TKNINKQPLQKTIKFYSSCFKNFRN

SEQ ID NO: 2356 - protein, 7 aa, Corononavirus-HKU1
KSLIIIS

SEQ ID NO: 2357 - protein, 20 aa, Corononavirus-HKU1
QIYRYSNRFNTISYIFPNCW

SEQ ID NO: 2358 - protein, 21 aa, Corononavirus-HKU1
QFISNPNNIITTCQIHIPNIN

SEQ ID NO: 2359 - protein, 27 aa, Corononavirus-HKU1
TFNNLNRTIFIINNNSIFYFNSLSNTL

SEQ ID NO: 2360 - protein, 19 aa, Corononavirus-HKU1
LNLFSTNLRFHNRSNHITL

SEQ ID NO: 2361 - protein, 29 aa, Corononavirus-HKU1
LLRYRINRQNTISIFRFKTRFIKISKRIQ

SEQ ID NO: 2362 - protein, 24 aa, Corononavirus-HKU1
CFIMTKPNNRLTKSFTSFKITFHI

SEQ ID NO: 2363 - protein, 29 aa, Corononavirus-HKU1
IIRCQNNITSSYRPDCYFVLNKRQIYIKT

SEQ ID NO: 2364 - protein, 12 aa, Corononavirus-HKU1
LIIQLSTNIMSN

SEQ ID NO: 2365 - protein, 33 aa, Corononavirus-HKU1
LKVSINTVNFSKWFKLSLYNRFCIILTIITIIL

SEQ ID NO: 2366 - protein, 25 aa, Corononavirus-HKU1
KIRVISNHFNIIQKIISQHRCKSLG

SEQ ID NO: 2367 - protein, 8 aa, Corononavirus-HKU1
IFKIQAVS

SEQ ID NO: 2368 - protein, 19 aa, Corononavirus-HKU1
TTTNTCIFFNTTSIIMLVR

SEQ ID NO: 2369 - protein, 24 aa, Corononavirus-HKU1
TTFQMCIMAYTYTHKHVSCNNIIR

SEQ ID NO: 2370 - protein, 40 aa, Corononavirus-HKU1
ILTQRSIRTNQKWYIQFSTMDNSTCTITANLITIKKISLC

SEQ ID NO: 2371 - protein, 24 aa, Corononavirus-HKU1
CTKMHNSINTNTTFLFNTTITNKF

SEQ ID NO: 2372 - protein, 5 aa, Corononavirus-HKU1
FTNCT

SEQ ID NO: 2373 - protein, 14 aa, Corononavirus-HKU1
ISLFQNNTNKISSI

SEQ ID NO: 2374 - protein, 10 aa, Corononavirus-HKU1
WFIKFKMTFS

SEQ ID NO: 2375 - protein, 4 aa, Corononavirus-HKU1
NKSN

SEQ ID NO: 2376 - protein, 58 aa, Corononavirus-HKU1
PMWSASTKFIPCFLPLPFIKFKINMLQHKTSYIHITIIMRLFKRKKWTVNNYRPFTYC

SEQ ID NO: 2377 - protein, 14 aa, Corononavirus-HKU1
KIIISKQLLLIKPK

SEQ ID NO: 2378 - protein, 8 aa, Corononavirus-HKU1
TLYSRNIS

SEQ ID NO: 2379 - protein, 7 aa, Corononavirus-HKU1
RQIFILI

SEQ ID NO: 2380 - protein, 10 aa, Corononavirus-HKU1
NFIGIKITTL

SEQ ID NO: 2381 - protein, 42 aa, Corononavirus-HKU1
LSNINAITENITKYFTKNFTYSKRNRFKINTIYSKQNIYLLS

SEQ ID NO: 2382 - protein, 78 aa, Corononavirus-HKU1
NTNLINSCFIKRTITYITKVFTLTTYINRIRTLKILNSFNTVNNIKFIDKTPIFRKTSHLRQQIITNVIIQLYIMTKQ

SEQ ID NO: 2383 - protein, 8 aa, Corononavirus-HKU1
NFLYNRRI

SEQ ID NO: 2384 - protein, 26 aa, Corononavirus-HKU1
NKTIITTQKKFVCICLKFNNTAYISS

SEQ ID NO: 2385 - protein, 10 aa, Corononavirus-HKU1
SNSQCFSTNN

SEQ ID NO: 2386 - protein, 26 aa, Corononavirus-HKU1
SNLTFLNNIKIFFIITNKDNLFINNT

SEQ ID NO: 2387 - protein, 29 aa, Corononavirus-HKU1
HISRNTKYTSRYESRQTTIIIIKMLISTC

SEQ ID NO: 2388 - protein, 22 aa, Corononavirus-HKU1
QNIRLSSILSSIRAYNIKNCFT

SEQ ID NO: 2389 - protein, 83 aa, Corononavirus-HKU1
FTTGRNITISYLANTFRFNHSSSFFRKFFTCSYSYSFCNSTTMEHMPISRINNNISFNKSSNIYNITFNKTYIRCYTQTIQLR

SEQ ID NO: 2390 - protein, 7 aa, Corononavirus-HKU1
LKRRHTK

SEQ ID NO: 2391 - protein, 58 aa, Corononavirus-HKU1
HSITYYKIKFITTKFSNKLTIYLFITYNSYRMTNVYIHSTCSNKNFFRGAKSTKIVIK

SEQ ID NO: 2392 - protein, 4 aa, Corononavirus-HKU1
VRCY

SEQ ID NO: 2393 - protein, 24 aa, Corononavirus-HKU1
SHIMSTLTNMRHNISIKKQSIQTI

SEQ ID NO: 2394 - protein, 7 aa, Corononavirus-HKU1
IKRKTTF

SEQ ID NO: 2395 - protein, 13 aa, Corononavirus-HKU1
TTPISIRINIKLV

SEQ ID NO: 2396 - protein, 23 aa, Corononavirus-HKU1
KPISKISYKTTLRQNNSFRNSGQ

SEQ ID NO: 2397 - protein, 13 aa, Corononavirus-HKU1
IINKTLIITHLIR

SEQ ID NO: 2398 - protein, 6 aa, Corononavirus-HKU1
PHIFNS

SEQ ID NO: 2399 - protein, 6 aa, Corononavirus-HKU1
ILKLKR

SEQ ID NO: 2400 - protein, 5 aa, Corononavirus-HKU1
FLHYK

SEQ ID NO: 2401 - protein, 13 aa, Corononavirus-HKU1
HRTQPTISMCNSR

SEQ ID NO: 2402 - protein, 28 aa, Corononavirus-HKU1
TINFKICFCFNTRTITNKQSIIIDIIKN

SEQ ID NO: 2403 - protein, 220 aa, Corononavirus-HKU1
KSFISIKVINTFNIIYIITSNNNLVIIVTSNNLFIVIVTSNNIFIVIVTSNNIFIVIVTSNNIFIVIVTSNNIFIVIVTSNNIFIVIVTSNNIFIVIVTSNNIFIVIVTSNNIFIVIVTSNNIFIVIVTSNNIFIVIVTSNNIFIVIVTSNNIFIVIVTSNNIFIVIVTSNNIFIVINSVFNDTINSIFDSFTTDNVFNILNSKSTIHTRGHCFITSLIK

SEQ ID NO: 2404 - protein, 9 aa, Corononavirus-HKU1
INNILIKFI

SEQ ID NO: 2405 - protein, 16 aa, Corononavirus-HKU1
KCTNLITNHWMLFTRV

SEQ ID NO: 2406 - protein, 24 aa, Corononavirus-HKU1
SILYSITNNSNKIIYSNTLFYFKF

SEQ ID NO: 2407 - protein, 4 aa, Corononavirus-HKU1
TNFT

SEQ ID NO: 2408 - protein, 7 aa, Corononavirus-HKU1
NIIKSRI

SEQ ID NO: 2409 - protein, 35 aa, Corononavirus-HKU1
IKHNLNCHQRRNLHNNRFLVKINFSTCTWKTPSLI

SEQ ID NO: 2410 - protein, 41 aa, Corononavirus-HKU1
KTNIFIIHDNREKFITTLTHVHIIYNTNFFYRFRWLTILIR

SEQ ID NO: 2411 - protein, 32 aa, Corononavirus-HKU1
RRFDILNNIIFYYNRFCNAFKKINLLFLCITW

SEQ ID NO: 2412 - protein, 5 aa, Corononavirus-HKU1
NKTRN

SEQ ID NO: 2413 - protein, 14 aa, Corononavirus-HKU1
PCTNVIKLIAYNTN

SEQ ID NO: 2414 - protein, 11 aa, Corononavirus-HKU1
TINSFKNRHIF

SEQ ID NO: 2415 - protein, 7 aa, Corononavirus-HKU1
NINCNTL

SEQ ID NO: 2416 - protein, 9 aa, Corononavirus-HKU1
LKKSVKFIN

SEQ ID NO: 2417 - protein, 7 aa, Corononavirus-HKU1
NFSIIRY

SEQ ID NO: 2418 - protein, 16 aa, Corononavirus-HKU1
SNKIKVGLRYYKKTIQ

SEQ ID NO: 2419 - protein, 13 aa, Corononavirus-HKU1
LVKKPACSRCTSI

SEQ ID NO: 2420 - protein, 16 aa, Corononavirus-HKU1
HGIKPINHFINKCSTQ

SEQ ID NO: 2421 - protein, 18 aa, Corononavirus-HKU1
LKLSNQPINIMLYIKCSN

SEQ ID NO: 2422 - protein, 10 aa, Corononavirus-HKU1
NSVHKQNTHF

SEQ ID NO: 2423 - protein, 7 aa, Corononavirus-HKU1
THIRNFL

SEQ ID NO: 2424 - protein, 14 aa, Corononavirus-HKU1
KLRHQRCKENTTLN

SEQ ID NO: 2425 - protein, 6 aa, Corononavirus-HKU1
IITTGN

SEQ ID NO: 2426 - protein, 27 aa, Corononavirus-HKU1
KRYKTISTNCKLASKISTTLNKQVNIF

SEQ ID NO: 2427 - protein, 36 aa, Corononavirus-HKU1
KHIIITSIKQQLPTPRIINAKNMILFKITTLTLNII

SEQ ID NO: 2428 - protein, 20 aa, Corononavirus-HKU1
VKCMSNKSSFFNNRFTTYYT

SEQ ID NO: 2429 - protein, 9 aa, Corononavirus-HKU1
INQIIIRLD

SEQ ID NO: 2430 - protein, 42 aa, Corononavirus-HKU1
RFNYRNPQSRTRRPIYTRTKWCDRITIQIKRIMVNSISTISK

SEQ ID NO: 2431 - protein, 9 aa, Corononavirus-HKU1
HRIFRNNTR

SEQ ID NO: 2432 - protein, 24 aa, Corononavirus-HKU1
LGFNFARVINCTTQWTRKTIHHIT

SEQ ID NO: 2433 - protein, 50 aa, Corononavirus-HKU1
NPTIKITIIIKTIYITILHNKTTITQINIIYRFNRKIIHMSHNFHQTRKL

SEQ ID NO: 2434 - protein, 6 aa, Corononavirus-HKU1
NYCISR

SEQ ID NO: 2435 - protein, 37 aa, Corononavirus-HKU1
MYRFTYNYISIYYIFCRLCNIFNTTNSSYSLQAHNKS

SEQ ID NO: 2436 - protein, 39 aa, Corononavirus-HKU1
ITNYMPSHYNIKVTIGKPYRLLLSHILQRIMTISLKTIC

SEQ ID NO: 2437 - protein, 23 aa, Corononavirus-HKU1
FTRIVTTILVYKKYGFNTTILSK

SEQ ID NO: 2438 - protein, 5 aa, Corononavirus-HKU1
SISFL

SEQ ID NO: 2439 - protein, 26 aa, Corononavirus-HKU1
IFTFRLSMNLSISIFYTKIIIIKFKI

SEQ ID NO: 2440 - protein, 53 aa, Corononavirus-HKU1
ITLFNIQPTELKPFVNIRWHKTKRYNPTQKIFTKISSRCSHRKMMYNITFSLV

SEQ ID NO: 2441 - protein, 18 aa, Corononavirus-HKU1
TEQAHNIPFRKTTQAMQR

SEQ ID NO: 2442 - protein, 11 aa, Corononavirus-HKU1
NCRTGLYGCFS

SEQ ID NO: 2443 - protein, 5 aa, Corononavirus-HKU1
NFYNM

SEQ ID NO: 2444 - protein, 11 aa, Corononavirus-HKU1
IFMNKNITDKI

SEQ ID NO: 2445 - protein, 34 aa, Corononavirus-HKU1
LHMPFLSKNAATIYLHMIIINESNTFHRLTSRGA

SEQ ID NO: 2446 - protein, 4 aa, Corononavirus-HKU1
PTLI

SEQ ID NO: 2447 - protein, 40 aa, Corononavirus-HKU1
LHRTSQLLRCIRKQPTKFWRPLEAETVFAGFNHCDLWEGR

SEQ ID NO: 2448 - protein, 15 aa, Corononavirus-HKU1
GQPTRHWQRDEKCGK

SEQ ID NO: 2449 - protein, 4 aa, Corononavirus-HKU1
NTRL

SEQ ID NO: 2450 - protein, 8 aa, Corononavirus-HKU1
LNHTHKHG

SEQ ID NO: 2451 - protein, 13 aa, Corononavirus-HKU1
QGILFKKFRFNEI

SEQ ID NO: 2452 - protein, 5 aa, Corononavirus-HKU1
QEIVS

SEQ ID NO: 2453 - protein, 9 aa, Corononavirus-HKU1
TVRTQFALI

SEQ ID NO: 2454 - DNA, 29942 bp, Corononavirus-HKU1; identical to SEQ ID NO: 1319
  CDS (3)..(29942)

SEQ ID NO: 2455 - protein, 5 aa, Corononavirus-HKU1
FFFFL

SEQ ID NO: 2456 - protein, 32 aa, Corononavirus-HKU1
FLQKAIINFNHILIYILNTTIDSSSRRRLYYS

SEQ ID NO: 2457 - protein, 4 aa, Corononavirus-HKU1
QSNV

SEQ ID NO: 2458 - protein, 5 aa, Corononavirus-HKU1
LIYSL

SEQ ID NO: 2459 - protein, 49 aa, Corononavirus-HKU1
QPTLSVITARIHSDRECPIPNNSEGLPPSVELGFILIKQQSLLHKDHQE

SEQ ID NO: 2460 - protein, 8 aa, Corononavirus-HKU1
QVNYDPQE

SEQ ID NO: 2461 - protein, 12 aa, Corononavirus-HKU1
NHLKCAEYQHLN

SEQ ID NO: 2462 - protein, 9 aa, Corononavirus-HKU1
ESQTVLVIV

SEQ ID NO: 2463 - protein, 7 aa, Corononavirus-HKU1
HLFYAEV

SEQ ID NO: 2464 - protein, 10 aa, Corononavirus-HKU1
NSTNQNQCSD

SEQ ID NO: 2465 - protein, 11 aa, Corononavirus-HKU1
RKHLNSLQELS

SEQ ID NO: 2466 - protein, 11 aa, Corononavirus-HKU1
LSQSLVKYYQT

SEQ ID NO: 2467 - protein, 10 aa, Corononavirus-HKU1
NQNNEVQKHL

SEQ ID NO: 2468 - protein, 9 aa, Corononavirus-HKU1
QVSQPRNLF

SEQ ID NO: 2469 - protein, 4 aa, Corononavirus-HKU1
PSLI

SEQ ID NO: 2470 - protein, 8 aa, Corononavirus-HKU1
NQRKKHLV

SEQ ID NO: 2471 - protein, 6 aa, Corononavirus-HKU1
ELILQE

SEQ ID NO: 2472 - protein, 5 aa, Corononavirus-HKU1
ETEDH

SEQ ID NO: 2473 - protein, 28 aa, Corononavirus-HKU1
YQALTFQHYQNFEKVLFYQNTVEHYNVY

SEQ ID NO: 2474 - protein, 13 aa, Corononavirus-HKU1
EFAFGEVLLKFYA

SEQ ID NO: 2475 - protein, 6 aa, Corononavirus-HKU1
FPWHFA

SEQ ID NO: 2476 - protein, 4 aa, Corononavirus-HKU1
LAEV

SEQ ID NO: 2477 - protein, 10 aa, Corononavirus-HKU1
NLYQAWLKQD

SEQ ID NO: 2478 - protein, 10 aa, Corononavirus-HKU1
RSHQPYQVLL

SEQ ID NO: 2479 - protein, 4 aa, Corononavirus-HKU1
NLNV

SEQ ID NO: 2480 - protein, 22 aa, Corononavirus-HKU1
NYFYLMNDYWVHVIENVNLVDY

SEQ ID NO: 2481 - protein, 21 aa, Corononavirus-HKU1
KQTFLSLQHNSLEAKSYQAET

SEQ ID NO: 2482 - protein, 9 aa, Corononavirus-HKU1
DPLTKHRRE

SEQ ID NO: 2483 - protein, 6 aa, Corononavirus-HKU1
KCQLGD

SEQ ID NO: 2484 - protein, 39 aa, Corononavirus-HKU1
QPRRPLRGIHHRMHWHMGRYRDSRNTISVTTAFVDHQLF

SEQ ID NO: 2485 - protein, 30 aa, Corononavirus-HKU1
KNAGCVYTNILLLQKGVLRKQWELLDHLKI

SEQ ID NO: 2486 - protein, 8 aa, Corononavirus-HKU1
SLYLFEIE

SEQ ID NO: 2487 - protein, 9 aa, Corononavirus-HKU1
SRRTRNNVG

SEQ ID NO: 2488 - protein, 6 aa, Corononavirus-HKU1
YFLVVE

SEQ ID NO: 2489 - protein, 7 aa, Corononavirus-HKU1
VGFFCLY

SEQ ID NO: 2490 - protein, 15 aa, Corononavirus-HKU1
RFGNFAQIGQPKKFS

SEQ ID NO: 2491 - protein, 22 aa, Corononavirus-HKU1
GFLNDFQRSFYFQHNDREYKTS

SEQ ID NO: 2492 - protein, 13 aa, Corononavirus-HKU1
FRFKLLTRQYPYH

SEQ ID NO: 2493 - protein, 8 aa, Corononavirus-HKU1
TVNDSYQL

SEQ ID NO: 2494 - protein, 7 aa, Corononavirus-HKU1
QKQQNHY

SEQ ID NO: 2495 - protein, 17 aa, Corononavirus-HKU1
HLTYLKRHVYRYKVLAP

SEQ ID NO: 2496 - protein, 14 aa, Corononavirus-HKU1
HIRANLKEYNQCQV

SEQ ID NO: 2497 - protein, 9 aa, Corononavirus-HKU1
HPVYKDDHE

SEQ ID NO: 2498 - protein, 8 aa, Corononavirus-HKU1
QLMCDSPQ

SEQ ID NO: 2499 - protein, 10 aa, Corononavirus-HKU1
QTSCLSYQYT

SEQ ID NO: 2500 - protein, 6 aa, Corononavirus-HKU1
DYWSLD

SEQ ID NO: 2501 - protein, 7 aa, Corononavirus-HKU1
NSTNCQF

SEQ ID NO: 2502 - protein, 5 aa, Corononavirus-HKU1
KAEYY

SEQ ID NO: 2503 - protein, 6 aa, Corononavirus-HKU1
QNKESI

SEQ ID NO: 2504 - protein, 13 aa, Corononavirus-HKU1
KMQEKHYSKHKNN

SEQ ID NO: 2505 - protein, 4 aa, Corononavirus-HKU1
SMAT

SEQ ID NO: 2506 - protein, 14 aa, Corononavirus-HKU1
DKQTYYGSYNRTAI

SEQ ID NO: 2507 - protein, 15 aa, Corononavirus-HKU1
KVVLHPKRNSILLRM

SEQ ID NO: 2508 - protein, 5 aa, Corononavirus-HKU1
QLDQK

SEQ ID NO: 2509 - protein, 8 aa, Corononavirus-HKU1
IEEEKIYS

SEQ ID NO: 2510 - protein, 5 aa, Corononavirus-HKU1
CLDLD

SEQ ID NO: 2511 - protein, 24 aa, Corononavirus-HKU1
SGWYNLFTIRLIQLHTSFINVSRR

SEQ ID NO: 2512 - protein, 18 aa, Corononavirus-HKU1
NNKEITKTTKLHTKLNSC

SEQ ID NO: 2513 - protein, 6 aa, Corononavirus-HKU1
KSNNKD

SEQ ID NO: 2514 - protein, 5 aa, Corononavirus-HKU1
RNKTK

SEQ ID NO: 2515 - protein, 12 aa, Corononavirus-HKU1
NLSYVPSSIIEK

SEQ ID NO: 2516 - protein, 5 aa, Corononavirus-HKU1
INHTY

SEQ ID NO: 2517 - protein, 7 aa, Corononavirus-HKU1
VPLHAKQ

SEQ ID NO: 2518 - protein, 8 aa, Corononavirus-HKU1
IQKLIQLI

SEQ ID NO: 2519 - protein, 10 aa, Corononavirus-HKU1
TQPQKQYYHK

SEQ ID NO: 2520 - protein, 16 aa, Corononavirus-HKU1
LQHQNYYYGKYRDYVM

SEQ ID NO: 2521 - protein, 22 aa, Corononavirus-HKU1
SEKQICQTCDTKHLKVQYSNQQ

SEQ ID NO: 2522 - protein, 14 aa, Corononavirus-HKU1
VDSNYTLDTNLQGL

SEQ ID NO: 2523 - protein, 4 aa, Corononavirus-HKU1
HQIL

SEQ ID NO: 2524 - protein, 6 aa, Corononavirus-HKU1
QENVCS

SEQ ID NO: 2525 - protein, 5 aa, Corononavirus-HKU1
VSKRP

SEQ ID NO: 2526 - protein, 8 aa, Corononavirus-HKU1
IKFRFNEI

SEQ ID NO: 2527 - protein, 50 aa, Corononavirus-HKU1
QEILIIMRCFDNKIMMTTILITTIMTFTKTCRTTTSTTTYKKEQYKEYYK

SEQ ID NO: 2528 - protein, 40 aa, Corononavirus-HKU1
PNIPRPFYIHFICTYIFKIDITIIQRLNRLLNKIHLIIQI

SEQ ID NO: 2529 - protein, 9 aa, Corononavirus-HKU1
KSSINSMKI

SEQ ID NO: 2530 - protein, 15 aa, Corononavirus-HKU1
SQIRRNGCLIFKPMR

SEQ ID NO: 2531 - protein, 35 aa, Corononavirus-HKU1
LRFKIRQFWYRMIQINKRRFSKINRTSIHKNNIFI

SEQ ID NO: 2532 - protein, 32 aa, Corononavirus-HKU1
NWFRIIVRTTSEHPMIIMFNKIPLFRCNTYIT

SEQ ID NO: 2533 - protein, 7 aa, Corononavirus-HKU1
YTQTRTY

SEQ ID NO: 2534 - protein, 23 aa, Corononavirus-HKU1
NSFKRNRFITKMHKQQTIRSILN

SEQ ID NO: 2535 - protein, 26 aa, Corononavirus-HKU1
QNMITITTKINTRRLTFNTLINLLHS

SEQ ID NO: 2536 - protein, 19 aa, Corononavirus-HKU1
SSTKFYKRNITKLLRDISI

SEQ ID NO: 2537 - protein, 13 aa, Corononavirus-HKU1
TTINKPINLNLSL

SEQ ID NO: 2538 - protein, 5 aa, Corononavirus-HKU1
SIETR

SEQ ID NO: 2539 - protein, 10 aa, Corononavirus-HKU1
RRTNCTKFIK

SEQ ID NO: 2540 - protein, 71 aa, Corononavirus-HKU1
QTIKCLSIRINNTLYFSKCRVGSTKTILNRKKSIIKSSSYQLLIFIKNIHSNTQTINSILYIKRKWYASCC

SEQ ID NO: 2541 - protein, 57 aa, Corononavirus-HKU1
PWWKHSSNSSGCGVTRNLRFRQNRRQNFNTIKGLYTKKISNFTTTSTIVISFNKTNI

SEQ ID NO: 2542 - protein, 7 aa, Corononavirus-HKU1
KFNFVKQ

SEQ ID NO: 2543 - protein, 14 aa, Corononavirus-HKU1
IFKKRTRRRTAVWT

SEQ ID NO: 2544 - protein, 37 aa, Corononavirus-HKU1
GFKINIINIKMQISIKIGAKCDTLHKSISYMQLSSIK

SEQ ID NO: 2545 - protein, 5 aa, Corononavirus-HKU1
TINFI

SEQ ID NO: 2546 - protein, 12 aa, Corononavirus-HKU1
NTINIITKSAIL

SEQ ID NO: 2547 - protein, 11 aa, Corononavirus-HKU1
VMASCIIRTDK

SEQ ID NO: 2548 - protein, 70 aa, Corononavirus-HKU1
RTINSNFRRISLNKFLLTNYSKVSGNFDLIKTTHRLNTVINKTDIKGFKSNKTIRSRNTSTFTTRRGRRR

SEQ ID NO: 2549 - protein, 21 aa, Corononavirus-HKU1
VIINTKTTTHAKSTRRNRIIS

SEQ ID NO: 2550 - protein, 18 aa, Corononavirus-HKU1
IISIKNATKITIKIWLSS

SEQ ID NO: 2551 - protein, 10 aa, Corononavirus-HKU1
RNIIQNIATF

SEQ ID NO: 2552 - protein, 4 aa, Corononavirus-HKU1
ITIK

SEQ ID NO: 2553 - protein, 82 aa, Corononavirus-HKU1
SQRGSILMKSSRNSSCITRENIICFISNKIFKTNNVAIRIIQKILPTIIINSRNFFKNTLSCNTIKVVINTNISKNFSIRLQ

SEQ ID NO: 2554 - protein, 12 aa, Corononavirus-HKU1
IIRTSGTTIDTI

SEQ ID NO: 2555 - protein, 20 aa, Corononavirus-HKU1
NKIRKNITTVVTDASVIRPT

SEQ ID NO: 2556 - protein, 12 aa, Corononavirus-HKU1
KGISTTKTRNII

SEQ ID NO: 2557 - protein, 40 aa, Corononavirus-HKU1
SIQYTTLFFINTEPCTMFTNTNQRLFLRTRPRVISSYRIR

SEQ ID NO: 2558 - protein, 37 aa, Corononavirus-HKU1
TRTPTPVSVVEYSSTLTRTIISTNRTGSRRWFMTLAT

SEQ ID NO: 2559 - protein, 19 aa, Corononavirus-HKU1
SKRRFSTRTKSIINRKTIT

SEQ ID NO: 2560 - protein, 74 aa, Corononavirus-HKU1
VNNTMRAQIKIIKTIPSIPRRRIIIINSNINCRQTIIQLTRTRSSVNFIIRRLQKTRTAQLQIRSSGVGYGKFI

SEQ ID NO: 2561 - protein, 25 aa, Corononavirus-HKU1
NNTLKTTTIYLRFIKIITRKRISMN

SEQ ID NO: 2562 - protein, 21 aa, Corononavirus-HKU1
TKQSTQIKVAIRKNFTFPIKR

SEQ ID NO: 2563 - protein, 15 aa, Corononavirus-HKU1
GYIKIVKPFINVTIR

SEQ ID NO: 2564 - protein, 17 aa, Corononavirus-HKU1
IRNTTMYSCNRLNSKTR

SEQ ID NO: 2565 - protein, 7 aa, Corononavirus-HKU1
VINTSIR

SEQ ID NO: 2566 - protein, 42 aa, Corononavirus-HKU1
RFSFTLNLAKETTRTINSISNNTTVVKFKKILAFRQRCDPIL

SEQ ID NO: 2567 - protein, 21 aa, Corononavirus-HKU1
SLIISIRRYSITSQRQNIIMR

SEQ ID NO: 2568 - protein, 8 aa, Corononavirus-HKU1
KSTKIQTK

SEQ ID NO: 2569 - protein, 127 aa, Corononavirus-HKU1
KSSRHARISIISIKSATFLIKMKIQPICRNIISKIFLEQTQRFRFIKMPRFITRTTFRFTNSMRILTHSVLTSCNLQNTIMRLNNNSIRVVNKNTTYNYSTKLTIQSFINIQLSILNSRKNTIIKIR

SEQ ID NO: 2570 - protein, 15 aa, Corononavirus-HKU1
KGFLIPKSTQICSTF

SEQ ID NO: 2571 - protein, 14 aa, Corononavirus-HKU1
IPKIGTRFREITSK

SEQ ID NO: 2572 - protein, 4 aa, Corononavirus-HKU1
YSSI

SEQ ID NO: 2573 - protein, 28 aa, Corononavirus-HKU1
INTIKYIICTQTIRNIHNILTYARNCGV

SEQ ID NO: 2574 - protein, 15 aa, Corononavirus-HKU1
IINSKISTIKITYNS

SEQ ID NO: 2575 - protein, 8 aa, Corononavirus-HKU1
CCRQNKNN

SEQ ID NO: 2576 - protein, 31 aa, Corononavirus-HKU1
DLSLYNKNNRKTTKSKAKHNKIPCKIIGKKS

SEQ ID NO: 2577 - protein, 17 aa, Corononavirus-HKU1
TQIGCLIIEDVGHLPKE

SEQ ID NO: 2578 - protein, 13 aa, Corononavirus-HKU1
GQMDVKLSYKNTP

SEQ ID NO: 2579 - protein, 29 aa, Corononavirus-HKU1
YEIQETLYKRPDKIEIKPLSPWLISYLPT

SEQ ID NO: 2580 - protein, 7 aa, Corononavirus-HKU1
LAEELRK

SEQ ID NO: 2581 - protein, 4 aa, Corononavirus-HKU1
QYGN

SEQ ID NO: 2582 - protein, 48 aa, Corononavirus-HKU1
HATDKEISEARSLFHLESTTCTGTNCLDLSKQRALVGKDKKGAVVETL

SEQ ID NO: 2583 - protein, 7 aa, Corononavirus-HKU1
EPGLREI

SEQ ID NO: 2584 - protein, 6 aa, Corononavirus-HKU1
IQSKSG

SEQ ID NO: 2585 - protein, 6 aa, Corononavirus-HKU1
TTLEKP

SEQ ID NO: 2586 - protein, 7 aa, Corononavirus-HKU1
TEPVSML

SEQ ID NO: 2587 - protein, 12 aa, Corononavirus-HKU1
LKLDLKRQSGTK

SEQ ID NO: 2588 - protein, 8 aa, Corononavirus-HKU1
REQPNKVK

SEQ ID NO: 2589 - protein, 4 aa, Corononavirus-HKU1
TSLE

SEQ ID NO: 2590 - protein, 24 aa, Corononavirus-HKU1
LIKIGLLSDKISLLQELNLERETL

SEQ ID NO: 2591 - protein, 7 aa, Corononavirus-HKU1
GISTKVR

SEQ ID NO: 2592 - protein, 11 aa, Corononavirus-HKU1
RKKAILEYKAR

SEQ ID NO: 2593 - protein, 20 aa, Corononavirus-HKU1
NLTLLRSHTSLLPLGKHLNL

SEQ ID NO: 2594 - protein, 7 aa, Corononavirus-HKU1
GLKLTPS

SEQ ID NO: 2595 - protein, 5 aa, Corononavirus-HKU1
SPSPV

SEQ ID NO: 2596 - protein, 4 aa, Corononavirus-HKU1
NRVK

SEQ ID NO: 2597 - protein, 21 aa, Corononavirus-HKU1
KLLKIESPALDEILPLLHKLG

SEQ ID NO: 2598 - protein, 27 aa, Corononavirus-HKU1
SKFLIFKLLIWLQSERLSPNKNQSWFK

SEQ ID NO: 2599 - protein, 10 aa, Corononavirus-HKU1
DTTLRGSLKP

SEQ ID NO: 2600 - protein, 9 aa, Corononavirus-HKU1
KNKKIINIV

SEQ ID NO: 2601 - protein, 20 aa, Corononavirus-HKU1
DLTSIYKTITNKNLFTRIAN

SEQ ID NO: 2602 - protein, 9 aa, Corononavirus-HKU1
FTSFNKRIN

SEQ ID NO: 2603 - protein, 4 aa, Corononavirus-HKU1
LIWS

SEQ ID NO: 2604 - protein, 17 aa, Corononavirus-HKU1
INNSSASQFQRKFSHIK

SEQ ID NO: 2605 - protein, 37 aa, Corononavirus-HKU1
TISTAIPCCTISPKQIVSMHNIAIYFKRRFTQVIYTY

SEQ ID NO: 2606 - protein, 22 aa, Corononavirus-HKU1
KPFTRRSIYISTKNCPKCKTTH

SEQ ID NO: 2607 - protein, 18 aa, Corononavirus-HKU1
ISIPRKLCNFYSYTTTQR

SEQ ID NO: 2608 - protein, 4 aa, Corononavirus-HKU1
FITN

SEQ ID NO: 2609 - protein, 37 aa, Corononavirus-HKU1
MTNVSKKPILTHIIITNIFSKRIIHIRYYQIPMTIKW

SEQ ID NO: 2610 - protein, 9 aa, Corononavirus-HKU1
SHTISKISN

SEQ ID NO: 2611 - protein, 7 aa, Corononavirus-HKU1
TIANKWV

SEQ ID NO: 2612 - protein, 10 aa, Corononavirus-HKU1
IIIYKNTTRW

SEQ ID NO: 2613 - protein, 14 aa, Corononavirus-HKU1
NSRTWSYFFIRPCT

SEQ ID NO: 2614 - protein, 8 aa, Corononavirus-HKU1
NTHINRNS

SEQ ID NO: 2615 - protein, 8 aa, Corononavirus-HKU1
CCSIQILT

SEQ ID NO: 2616 - protein, 22 aa, Corononavirus-HKU1
LSVLSNIHHTACRQINRFTIIP

SEQ ID NO: 2617 - protein, 4 aa, Corononavirus-HKU1
RDSL

SEQ ID NO: 2618 - protein, 58 aa, Corononavirus-HKU1
WNIQILIQNRHRIARFPIISGLHFRIKSHNFIIITPQHKLKILKINININNFTNTTQI

SEQ ID NO: 2619 - protein, 8 aa, Corononavirus-HKU1
LNNRNKII

SEQ ID NO: 2620 - protein, 19 aa, Corononavirus-HKU1
INNCTNTLTTTTLLISNKI

SEQ ID NO: 2621 - protein, 7 aa, Corononavirus-HKU1
MNTRIIL

SEQ ID NO: 2622 - protein, 4 aa, Corononavirus-HKU1
KLLN

SEQ ID NO: 2623 - protein, 9 aa, Corononavirus-HKU1
QIRFFFPTK

SEQ ID NO: 2624 - protein, 26 aa, Corononavirus-HKU1
AYKQMQTSYNFMVKTTINYMIKCIVF

SEQ ID NO: 2625 - protein, 17 aa, Corononavirus-HKU1
TIFSNKQIIIHINKIPF

SEQ ID NO: 2626 - protein, 5 aa, Corononavirus-HKU1
ARFKT

SEQ ID NO: 2627 - protein, 12 aa, Corononavirus-HKU1
QYTTLSKDSKTC

SEQ ID NO: 2628 - protein, 13 aa, Corononavirus-HKU1
SIITNDITRAITT

SEQ ID NO: 2629 - protein, 9 aa, Corononavirus-HKU1
ITLWAPVMA

SEQ ID NO: 2630 - protein, 33 aa, Corononavirus-HKU1
AVCSAEDNIVTIFSHSEPKLNFEFSNFIHNHTI

SEQ ID NO: 2631 - protein, 9 aa, Corononavirus-HKU1
ISSLRTFNH

SEQ ID NO: 2632 - protein, 16 aa, Corononavirus-HKU1
FFSTNKNTISCFSKSF

SEQ ID NO: 2633 - protein, 76 aa, Corononavirus-HKU1
SASVTTIKKYIQIFDELQICVFTNTISGTTKQTIFNIIPQDMLPTNINVQISKNLKFRVVPDTTFCKQFNSYISRK

SEQ ID NO: 2634 - protein, 25 aa, Corononavirus-HKU1
CIIFKNNSIYIINLNNNFVIHNSTR

SEQ ID NO: 2635 - protein, 19 aa, Corononavirus-HKU1
FTCTSIIMTNINQVIYYVF

SEQ ID NO: 2636 - protein, 6 aa, Corononavirus-HKU1
RSKSVP

SEQ ID NO: 2637 - protein, 33 aa, Corononavirus-HKU1
IIKIKILINPKSKACCSNYIIRLKVVTIFFSML

SEQ ID NO: 2638 - protein, 5 aa, Corononavirus-HKU1
TNSST

SEQ ID NO: 2639 - protein, 10 aa, Corononavirus-HKU1
ITPCDTSGAS

SEQ ID NO: 2640 - protein, 9 aa, Corononavirus-HKU1
RNVINLFRF

SEQ ID NO: 2641 - protein, 9 aa, Corononavirus-HKU1
TIYVHTRRI

SEQ ID NO: 2642 - protein, 38 aa, Corononavirus-HKU1
IIEKRHRLKIFKNSSSKRISMECMFINIQTTTITSRKV

SEQ ID NO: 2643 - protein, 9 aa, Corononavirus-HKU1
HSSVKSTNN

SEQ ID NO: 2644 - protein, 14 aa, Corononavirus-HKU1
IRWIFINITIPKHT

SEQ ID NO: 2645 - protein, 14 aa, Corononavirus-HKU1
TIFKIIFMHIIDIK

SEQ ID NO: 2646 - protein, 22 aa, Corononavirus-HKU1
LFNRLGYRKSIIKFKFIIFDTS

SEQ ID NO: 2647 - protein, 9 aa, Corononavirus-HKU1
TFRIAYVIT

SEQ ID NO: 2648 - protein, 5 aa, Corononavirus-HKU1
VVSIT

SEQ ID NO: 2649 - protein, 10 aa, Corononavirus-HKU1
HGSFKHDTLQ

SEQ ID NO: 2650 - protein, 16 aa, Corononavirus-HKU1
PTRCIYTDLIRNYWIL

SEQ ID NO: 2651 - protein, 13 aa, Corononavirus-HKU1
IPINRFTKTIIDC

SEQ ID NO: 2652 - protein, 8 aa, Corononavirus-HKU1
TTSHNCIS

SEQ ID NO: 2653 - protein, 17 aa, Corononavirus-HKU1
RNMCTFMYITNYIVITS

SEQ ID NO: 2654 - protein, 51 aa, Corononavirus-HKU1
RTCITPLLYIYNKWIIHIITSITMAPTTIITSSRIVACSTIRTHITIKLSA

SEQ ID NO: 2655 - protein, 5 aa, Corononavirus-HKU1
FSKIP

SEQ ID NO: 2656 - protein, 19 aa, Corononavirus-HKU1
TSKFKTGRPSNKYYTIRKV

SEQ ID NO: 2657 - protein, 4 aa, Corononavirus-HKU1
KIIR

SEQ ID NO: 2658 - protein, 15 aa, Corononavirus-HKU1
HLNNSNSNNIPLLTF

SEQ ID NO: 2659 - protein, 4 aa, Corononavirus-HKU1
HKGY

SEQ ID NO: 2660 - protein, 24 aa, Corononavirus-HKU1
MFKFFTRRSFSYSFFKSITISLSK

SEQ ID NO: 2661 - protein, 11 aa, Corononavirus-HKU1
ASSFNYKIHTS

SEQ ID NO: 2662 - protein, 49 aa, Corononavirus-HKU1
KTYLQWKVCSNVFASSMSALNIKTNPTSNTFNGFIFSNKQFRITIKSQI

SEQ ID NO: 2663 - protein, 7 aa, Corononavirus-HKU1
FKTHKRY

SEQ ID NO: 2664 - protein, 4 aa, Corononavirus-HKU1
TRIC

SEQ ID NO: 2665 - protein, 6 aa, Corononavirus-HKU1
NRFTNI

SEQ ID NO: 2666 - protein, 15 aa, Corononavirus-HKU1
IYSQIFINLIFIINC

SEQ ID NO: 2667 - protein, 8 aa, Corononavirus-HKU1
GGMRWMIT

SEQ ID NO: 2668 - protein, 17 aa, Corononavirus-HKU1
ATFTTIFKKISCAMQTR

SEQ ID NO: 2669 - protein, 7 aa, Corononavirus-HKU1
SLILNFI

SEQ ID NO: 2670 - protein, 8 aa, Corononavirus-HKU1
SNKIKRFK

SEQ ID NO: 2671 - protein, 33 aa, Corononavirus-HKU1
LHITHNTKNALLGSSYGNIKSININRMGCFCCL

SEQ ID NO: 2672 - protein, 20 aa, Corononavirus-HKU1
IYNIIIFRTLSRIYSLCLNT

SEQ ID NO: 2673 - protein, 25 aa, Corononavirus-HKU1
NTLSNIILTIIRTNKNSTIPNWISF

SEQ ID NO: 2674 - protein, 4 aa, Corononavirus-HKU1
KFTN

SEQ ID NO: 2675 - protein, 9 aa, Corononavirus-HKU1
IYLLNIYST

SEQ ID NO: 2676 - protein, 14 aa, Corononavirus-HKU1
TLMCCLSLKIYFKT

SEQ ID NO: 2677 - protein, 15 aa, Corononavirus-HKU1
TIIIFSLEFIIINQC

SEQ ID NO: 2678 - protein, 20 aa, Corononavirus-HKU1
NSFYNFFRTPITISQKDIRT

SEQ ID NO: 2679 - protein, 14 aa, Corononavirus-HKU1
TTHYFSNRIEVPRF

SEQ ID NO: 2680 - protein, 11 aa, Corononavirus-HKU1
RTLAQQHTWCR

SEQ ID NO: 2681 - protein, 41 aa, Corononavirus-HKU1
LSRISNIYIMFSFNTSIYNRQFIISKHTNFINNNNICNQLW

SEQ ID NO: 2682 - protein, 37 aa, Corononavirus-HKU1
CIYCGKNILTSGIINFKLIITIYTNFSRNNTCTIVNI

SEQ ID NO: 2683 - protein, 29 aa, Corononavirus-HKU1
KLISFFTQCIYSSMTSSSINYTCCVVINS

SEQ ID NO: 2684 - protein, 58 aa, Corononavirus-HKU1
TYSKMRLSRTRGTLNSAITFHSNVLIISNIILKHQWNTINTRKSYTSIVLLWDKCRCT

SEQ ID NO: 2685 - protein, 5 aa, Corononavirus-HKU1
TSYRM

SEQ ID NO: 2686 - protein, 21 aa, Corononavirus-HKU1
NKNITYRKFISSCSAVIHTVS

SEQ ID NO: 2687 - protein, 9 aa, Corononavirus-HKU1
FTFIKNILT

SEQ ID NO: 2688 - protein, 62 aa, Corononavirus-HKU1
NCLTSTSKMVACENIIFIKWWFNFTCLPTQNNFSITNNLLNGSRSIALFKSLFSCLLSFCSK

SEQ ID NO: 2689 - protein, 29 aa, Corononavirus-HKU1
TFNTLICQNIIINFCPFTTSYLIKIIYIR

SEQ ID NO: 2690 - protein, 16 aa, Corononavirus-HKU1
TRARLFIQTKDHTIHN

SEQ ID NO: 2691 - protein, 16 aa, Corononavirus-HKU1
IMGFMVFTIVRHTAQI

SEQ ID NO: 2692 - protein, 16 aa, Corononavirus-HKU1
FGDITHITVRCITNVR

SEQ ID NO: 2693 - protein, 20 aa, Corononavirus-HKU1
DTQNIFMISCHNMVITTFTT

SEQ ID NO: 2694 - protein, 14 aa, Corononavirus-HKU1
QRLTYTTATTQRSL

SEQ ID NO: 2695 - protein, 14 aa, Corononavirus-HKU1
TNNACTYTLHHGTF

SEQ ID NO: 2696 - protein, 6 aa, Corononavirus-HKU1
IHILVK

SEQ ID NO: 2697 - protein, 5 aa, Corononavirus-HKU1
FFSKL

SEQ ID NO: 2698 - protein, 5 aa, Corononavirus-HKU1
TITST

SEQ ID NO: 2699 - protein, 6 aa, Corononavirus-HKU1
NNTITI

SEQ ID NO: 2700 - protein, 14 aa, Corononavirus-HKU1
DLSTKIIIQFFYIF

SEQ ID NO: 2701 - protein, 15 aa, Corononavirus-HKU1
IYTKDFLVFFIFMMY

SEQ ID NO: 2702 - protein, 6 aa, Corononavirus-HKU1
RVSIYS

SEQ ID NO: 2703 - protein, 14 aa, Corononavirus-HKU1
TYKALYQKNTVSLQ

SEQ ID NO: 2704 - protein, 8 aa, Corononavirus-HKU1
IINKTTSS

SEQ ID NO: 2705 - protein, 8 aa, Corononavirus-HKU1
NSRRIWIW

SEQ ID NO: 2706 - protein, 9 aa, Corononavirus-HKU1
INIITIYLN

SEQ ID NO: 2707 - protein, 69 aa, Corononavirus-HKU1
HSMLGTKFMRTISNIIFNPTFRFRHKDIILIVQNLLKNTYISYITLTSIIRVITDNTIITQNHHTKMLT

SEQ ID NO: 2708 - protein, 21 aa, Corononavirus-HKU1
KFIILINKCIINIICTINIRV

SEQ ID NO: 2709 - protein, 4 aa, Corononavirus-HKU1
IAYT

SEQ ID NO: 2710 - protein, 70 aa, Corononavirus-HKU1
IFNLMAITGHKRTNISSNSLTYIKNRISKSSSCITTASTTRLNIIATATHNYFTQNLSTFIRKAIKSITM

SEQ ID NO: 2711 - protein, 10 aa, Corononavirus-HKU1
TTKFMFAGQN

SEQ ID NO: 2712 - protein, 33 aa, Corononavirus-HKU1
TTNNTQNIWHSTITFRIIPTHKNRVVNILYKMT

SEQ ID NO: 2713 - protein, 57 aa, Corononavirus-HKU1
HIVPTTIKFSGSYNNRNTSGSCYTLQTFLMEHSACHSTKNRNTCYSASSILSTDSIF

SEQ ID NO: 2714 - protein, 4 aa, Corononavirus-HKU1
IHLS

SEQ ID NO: 2715 - protein, 18 aa, Corononavirus-HKU1
GGQNITFSICINFILFLK

SEQ ID NO: 2716 - protein, 27 aa, Corononavirus-HKU1
CLIIKSGFTKFIKWITSTFIIIINNNL

SEQ ID NO: 2717 - protein, 17 aa, Corononavirus-HKU1
CWYTTTIINFKIFINNF

SEQ ID NO: 2718 - protein, 8 aa, Corononavirus-HKU1
LLNINHSR

SEQ ID NO: 2719 - protein, 68 aa, Corononavirus-HKU1
IILIIIIISNCSITILSKEKMFQINCTTLFKQAFTFNKLVKVLVKVTWFYSLKFYTTCNGSYTKTTSS

SEQ ID NO: 2720 - protein, 19 aa, Corononavirus-HKU1
IKQSTSRCNVHSRICCIKK

SEQ ID NO: 2721 - protein, 13 aa, Corononavirus-HKU1
IFKRQTITVCVNI

SEQ ID NO: 2722 - protein, 5 aa, Corononavirus-HKU1
VHNYT

SEQ ID NO: 2723 - protein, 29 aa, Corononavirus-HKU1
LFVMVTNRNNKRYTIYKNLSNKGTKTSIR

SEQ ID NO: 2724 - protein, 4 aa, Corononavirus-HKU1
NHTK

SEQ ID NO: 2725 - protein, 35 aa, Corononavirus-HKU1
YIKISTMNNTPIIITIHSIRMILHTPILKILIKQL

SEQ ID NO: 2726 - protein, 20 aa, Corononavirus-HKU1
LVISKIILYKIELSITIINK

SEQ ID NO: 2727 - protein, 43 aa, Corononavirus-HKU1
YMTHSQHRHHIRIVRICNCHTKPWGCLYKITKIIPLTIQILVI

SEQ ID NO: 2728 - protein, 4 aa, Corononavirus-HKU1
TYFN

SEQ ID NO: 2729 - protein, 9 aa, Corononavirus-HKU1
GVCKNDSIK

SEQ ID NO: 2730 - protein, 7 aa, Corononavirus-HKU1
SSIKNRA

SEQ ID NO: 2731 - protein, 37 aa, Corononavirus-HKU1
FFIYINNIRIFNKIIPIFLRKVGFFTISILTKNFTQY

SEQ ID NO: 2732 - protein, 14 aa, Corononavirus-HKU1
TIITIKMTQCIAKI

SEQ ID NO: 2733 - protein, 4 aa, Corononavirus-HKU1
HSIL

SEQ ID NO: 2734 - protein, 42 aa, Corononavirus-HKU1
KIPTNYMWHATTINIKCKEIMFSHNTTTFSQLIISFLFIINF

SEQ ID NO: 2735 - protein, 29 aa, Corononavirus-HKU1
ISSFDNKELIQFITVVIYTLKTATIHFII

SEQ ID NO: 2736 - protein, 14 aa, Corononavirus-HKU1
TYTSSIGITNVKCP

SEQ ID NO: 2737 - protein, 5 aa, Corononavirus-HKU1
LNISR

SEQ ID NO: 2738 - protein, 6 aa, Corononavirus-HKU1
TTSTGY

SEQ ID NO: 2739 - protein, 18 aa, Corononavirus-HKU1
PGIHTSTPNPFKKFKSLD

SEQ ID NO: 2740 - protein, 19 aa, Corononavirus-HKU1
TATLEPTQEQLPSLQKPQT

SEQ ID NO: 2741 - protein, 7 aa, Corononavirus-HKU1
QTSCVNT

SEQ ID NO: 2742 - protein, 32 aa, Corononavirus-HKU1
RIGSFIPKGTCTNLPRNLHIPSTSGCSTRARQ

SEQ ID NO: 2743 - protein, 7 aa, Corononavirus-HKU1
IQTEAPP

SEQ ID NO: 2744 - protein, 19 aa, Corononavirus-HKU1
ESWLIVASGLIVMAIPVPA

SEQ ID NO: 2745 - protein, 17 aa, Corononavirus-HKU1
SQSILTQLIIGTPPCCI

SEQ ID NO: 2746 - protein, 50 aa, Corononavirus-HKU1
VFLGSTENAHNESIEELAAYSVATPACNLIVEDKVPTTHPLAKVLHPLIK

SEQ ID NO: 2747 - protein, 45 aa, Corononavirus-HKU1
RYLILSPLTSCIENLQGGSSSKTTQFPSSFIILVYLRPSTSLRTA

SEQ ID NO: 2748 - protein, 9 aa, Corononavirus-HKU1
TILPLLPLL

SEQ ID NO: 2749 - protein, 19 aa, Corononavirus-HKU1
VGILQFISEPLLTTCIFNL

SEQ ID NO: 2750 - protein, 42 aa, Corononavirus-HKU1
GINSLFCITALATSLYLFAMITRGQLESTLISVNCLLIPSAS

SEQ ID NO: 2751 - protein, 13 aa, Corononavirus-HKU1
TVCICHTLPAYVT

SEQ ID NO: 2752 - protein, 44 aa, Corononavirus-HKU1
TLSTTLSKTCLSGITIVKVLAANAGIALKGTQPLTALSRIEFKA

SEQ ID NO: 2753 - protein, 68 aa, Corononavirus-HKU1
LSNLRTMLKSIVCKAETTLLFLSLIRASLYMLVSARSAIRSSLRATALSRSYTDLAILHAFSNCFICC

SEQ ID NO: 2754 - protein, 38 aa, Corononavirus-HKU1
LTEPLFLASAKFFFATSYSTKLAIFTNSLCKACKTVLS

SEQ ID NO: 2755 - protein, 26 aa, Corononavirus-HKU1
SSLTSSILARHLVSTAAGLANKTINN

SEQ ID NO: 2756 - protein, 53 aa, Corononavirus-HKU1
ASLSKATLKSEVDSISLCKTLQYCHNLELEATCKCCKQFNKTTLAHFTSVNFD

SEQ ID NO: 2757 - protein, 36 aa, Corononavirus-HKU1
IWETSITGTPPIPSSFKFNKIASKLLRGGRKPLAFI

SEQ ID NO: 2758 - protein, 4 aa, Corononavirus-HKU1
TEIL

SEQ ID NO: 2759 - protein, 17 aa, Corononavirus-HKU1
TPIGILKTLFKREKNPQ

SEQ ID NO: 2760 - protein, 9 aa, Corononavirus-HKU1
QDKIYPINK

SEQ ID NO: 2761 - protein, 7 aa, Corononavirus-HKU1
LKRINLI

SEQ ID NO: 2762 - protein, 5 aa, Corononavirus-HKU1
GTSVK

SEQ ID NO: 2763 - protein, 23 aa, Corononavirus-HKU1
NILTDNQLATIFAIANDKIVVHV

SEQ ID NO: 2764 - protein, 39 aa, Corononavirus-HKU1
VPKKAVINNKTSSSKFDPKYHIEIKVTILPTKNIKEKMS

SEQ ID NO: 2765 - protein, 17 aa, Corononavirus-HKU1
LILCIVIKIAKTHKIQP

SEQ ID NO: 2766 - protein, 13 aa, Corononavirus-HKU1
VKFTAGTKYESQT

SEQ ID NO: 2767 - protein, 8 aa, Corononavirus-HKU1
VKPLKPSL

SEQ ID NO: 2768 - protein, 13 aa, Corononavirus-HKU1
NKVQSTGIIYIVK

SEQ ID NO: 2769 - protein, 52 aa, Corononavirus-HKU1
KCLCLTSNIIKLTKQSTHNVTPIICVLIYINIVHLTNAEIIQLNKNVDIKIQ

SEQ ID NO: 2770 - protein, 19 aa, Corononavirus-HKU1
IVSLINLFVLDCNLTPANC

SEQ ID NO: 2771 - protein, 16 aa, Corononavirus-HKU1
TSEGANSSSKVQLPSI

SEQ ID NO: 2772 - protein, 64 aa, Corononavirus-HKU1
NPIYRRLIAANKVSIETPVIEAKASKTRSAFTWLKPFAIAQTLKSSVEQTSFCTNQAQLLSIAA

SEQ ID NO: 2773 - protein, 10 aa, Corononavirus-HKU1
SQAITLTVWT

SEQ ID NO: 2774 - protein, 8 aa, Corononavirus-HKU1
SLTGNCTT

SEQ ID NO: 2775 - protein, 6 aa, Corononavirus-HKU1
ASLYGP

SEQ ID NO: 2776 - protein, 9 aa, Corononavirus-HKU1
KLPVKSVPV

SEQ ID NO: 2777 - protein, 7 aa, Corononavirus-HKU1
QPVLSSN

SEQ ID NO: 2778 - protein, 13 aa, Corononavirus-HKU1
CIYTNLTLSPVNT

SEQ ID NO: 2779 - protein, 15 aa, Corononavirus-HKU1
PTDPHDPHKKEPLIV

SEQ ID NO: 2780 - protein, 6 aa, Corononavirus-HKU1
LLRIVT

SEQ ID NO: 2781 - protein, 29 aa, Corononavirus-HKU1
NAPCGRPLYAAKTVKVSPGLTLPKVYFGV

SEQ ID NO: 2782 - protein, 10 aa, Corononavirus-HKU1
GFCKETVKTS

SEQ ID NO: 2783 - protein, 5 aa, Corononavirus-HKU1
QPCIW

SEQ ID NO: 2784 - protein, 25 aa, Corononavirus-HKU1
DTTVKLIRPDIIVKSPRVTLHNKAE

SEQ ID NO: 2785 - protein, 12 aa, Corononavirus-HKU1
SGSFILEDEHIT

SEQ ID NO: 2786 - protein, 14 aa, Corononavirus-HKU1
TLSSNHKPFKVILP

SEQ ID NO: 2787 - protein, 42 aa, Corononavirus-HKU1
VTLTIQGSIFDVGDTIFTIPDCKKDVETDAVGGWYKTSLPLL

SEQ ID NO: 2788 - protein, 9 aa, Corononavirus-HKU1
LNVSIALAN

SEQ ID NO: 2789 - protein, 6 aa, Corononavirus-HKU1
EHAASL

SEQ ID NO: 2790 - protein, 8 aa, Corononavirus-HKU1
AAVSILPL

SEQ ID NO: 2791 - protein, 11 aa, Corononavirus-HKU1
RYLLYKLKYLL

SEQ ID NO: 2792 - protein, 11 aa, Corononavirus-HKU1
ATSETEFFNLQ

SEQ ID NO: 2793 - protein, 76 aa, Corononavirus-HKU1
ESLVIIKVVRDVSSNVLSLHTLTPIFLQYENNHKTWFAITIATYVTQNQKGIIAPYITIHCKCIITLISEGKYNVT

SEQ ID NO: 2794 - protein, 6 aa, Corononavirus-HKU1
THAQIG

SEQ ID NO: 2795 - protein, 21 aa, Corononavirus-HKU1
KTKSIRKLIHQTTTFITTTLV

SEQ ID NO: 2796 - protein, 10 aa, Corononavirus-HKU1
SPKARLSFIK

SEQ ID NO: 2797 - protein, 32 aa, Corononavirus-HKU1
KTKTTTIANIAPKIELAVREKKSIGRIKLLKN

SEQ ID NO: 2798 - protein, 16 aa, Corononavirus-HKU1
NKSKRSLPQKVPGILL

SEQ ID NO: 2799 - protein, 26 aa, Corononavirus-HKU1
SLFKTQELLKLKHIPSSAYSHAPTLQ

SEQ ID NO: 2800 - protein, 29 aa, Corononavirus-HKU1
VIERVLTIRTIPSLITSGNLIKPLELARL

SEQ ID NO: 2801 - protein, 19 aa, Corononavirus-HKU1
RVCGTKDVYKEAFFITPSE

SEQ ID NO: 2802 - protein, 22 aa, Corononavirus-HKU1
GCGVPSPLLNIVHKDDKTQPLA

SEQ ID NO: 2803 - protein, 4 aa, Corononavirus-HKU1
ICGV

SEQ ID NO: 2804 - protein, 7 aa, Corononavirus-HKU1
TLSLANA

SEQ ID NO: 2805 - protein, 6 aa, Corononavirus-HKU1
VKKCKT

SEQ ID NO: 2806 - protein, 32 aa, Corononavirus-HKU1
KPCLKTLVGTLNIVEPISSSITATTIGQSIEL

SEQ ID NO: 2807 - protein, 9 aa, Corononavirus-HKU1
TDPKVDSYH

SEQ ID NO: 2808 - protein, 29 aa, Corononavirus-HKU1
SNWKNLLAKHKSLTEISLTTPLSITLKLA

SEQ ID NO: 2809 - protein, 4 aa, Corononavirus-HKU1
ISDL

SEQ ID NO: 2810 - protein, 73 aa, Corononavirus-HKU1
TLYVGNKAHNNIKQIKLTKNNIYNKLLNTTPPLSEKGVVRIGTLASCLLKVNFNFKPVLTHAFFNLCCKSAVS

SEQ ID NO: 2811 - protein, 49 aa, Corononavirus-HKU1
LKASINHIQEILAALATLPCTCLAPFCIRTPKSAATILSLFKYVGTKLL

SEQ ID NO: 2812 - protein, 53 aa, Corononavirus-HKU1
FSSVNSKPAATADIIDLVINLVSTSESMEQHLRTHPTKVSKTFSNCTPSLREA

SEQ ID NO: 2813 - protein, 15 aa, Corononavirus-HKU1
AMLTKLLKLFLSTSK

SEQ ID NO: 2814 - protein, 6 aa, Corononavirus-HKU1
DIKVST

SEQ ID NO: 2815 - protein, 32 aa, Corononavirus-HKU1
TSNIVWVTEIPLQAVVINFLSTSNIGLYNDCA

SEQ ID NO: 2816 - protein, 45 aa, Corononavirus-HKU1
NTTAFRKLALSASLSTTTTYKLGTTLTLECNRLLISTNKLASTSS

SEQ ID NO: 2817 - protein, 7 aa, Corononavirus-HKU1
TRCPSLS

SEQ ID NO: 2818 - protein, 15 aa, Corononavirus-HKU1
NKRIIQPTCLISVTT

SEQ ID NO: 2819 - protein, 39 aa, Corononavirus-HKU1
CEASVGFTGRLSSLESSIAASTVIKVLPGLKEWQLKQFH

SEQ ID NO: 2820 - protein, 14 aa, Corononavirus-HKU1
CLTQKPVPPLAVIS

SEQ ID NO: 2821 - protein, 19 aa, Corononavirus-HKU1
RITPPTIVLHLTRTLQFRL

SEQ ID NO: 2822 - protein, 10 aa, Corononavirus-HKU1
QNKQPALLQP

SEQ ID NO: 2823 - protein, 17 aa, Corononavirus-HKU1
TICLIKPTTLYIAVTTI

SEQ ID NO: 2824 - protein, 46 aa, Corononavirus-HKU1
NRNKTKAGNILATNTINLINQCIVSNINKSGNHVVNNCKPIRQNNG

SEQ ID NO: 2825 - protein, 7 aa, Corononavirus-HKU1
NHTVYNE

SEQ ID NO: 2826 - protein, 13 aa, Corononavirus-HKU1
PITSSTINLTKLT

SEQ ID NO: 2827 - protein, 10 aa, Corononavirus-HKU1
SNKTRLSTSY

SEQ ID NO: 2828 - protein, 15 aa, Corononavirus-HKU1
TKSIAAYVSNISKPE

SEQ ID NO: 2829 - protein, 11 aa, Corononavirus-HKU1
HNSHIKLPLQK

SEQ ID NO: 2830 - protein, 9 aa, Corononavirus-HKU1
LVKPTPNLE

SEQ ID NO: 2831 - protein, 30 aa, Corononavirus-HKU1
KSQIVTKPKVAFIHITILPTKIGKTLILGR

SEQ ID NO: 2832 - protein, 34 aa, Corononavirus-HKU1
KSLKITFIYKKLNQNKNTVATTRKPFINILHLNV

SEQ ID NO: 2833 - protein, 21 aa, Corononavirus-HKU1
KAFLRAKQNKLKVNLEAISVV

SEQ ID NO: 2834 - protein, 14 aa, Corononavirus-HKU1
KMVLSFVKCNKLKT

SEQ ID NO: 2835 - protein, 8 aa, Corononavirus-HKU1
INNHFKKP

SEQ ID NO: 2836 - protein, 15 aa, Corononavirus-HKU1
NSIALALKILGTKRV

SEQ ID NO: 2837 - protein, 41 aa, Corononavirus-HKU1
LSSLKHNKSIGIVIGLIPYRIYSLTVGDLTRRDNSLATQTT

SEQ ID NO: 2838 - protein, 86 aa, Corononavirus-HKU1
SQPVKYISQTSTKDKLLTTLIELFSSLTIIASSILTVFLTPFNLTSLVLICDSITEVTTLPCDSSDTESTDKTLYLFSDLKLGLLK

SEQ ID NO: 2839 - protein, 9 aa, Corononavirus-HKU1
VREFNDASS

SEQ ID NO: 2840 - protein, 15 aa, Corononavirus-HKU1
QNQITGLPKVSHPLK

SEQ ID NO: 2841 - protein, 39 aa, Corononavirus-HKU1
RFTYKSSDAKTTSPVATGQTVTLYSTNGKSTLKPNLSFN

SEQ ID NO: 2842 - protein, 12 aa, Corononavirus-HKU1
AQISCPTNLKLV

SEQ ID NO: 2843 - protein, 10 aa, Corononavirus-HKU1
TPSTLANGLN

SEQ ID NO: 2844 - protein, 7 aa, Corononavirus-HKU1
AFIIGFV

SEQ ID NO: 2845 - protein, 6 aa, Corononavirus-HKU1
YLPLSQ

SEQ ID NO: 2846 - protein, 7 aa, Corononavirus-HKU1
YCERSGL

SEQ ID NO: 2847 - protein, 9 aa, Corononavirus-HKU1
ATISTSSKK

SEQ ID NO: 2848 - protein, 34 aa, Corononavirus-HKU1
LVNIDVKVWVKFLRYKQSVKQPLTPVYFLTLQAS

SEQ ID NO: 2849 - protein, 8 aa, Corononavirus-HKU1
GEPHFKCV

SEQ ID NO: 2850 - protein, 49 aa, Corononavirus-HKU1
WPTPTPINMLAATTSSGKSLLRGVLEQIKNGTFNLVQWTILPAQLQPIL

SEQ ID NO: 2851 - protein, 62 aa, Corononavirus-HKU1
PLKRSVFANVPKCITASTPTRLSCLIPQSQISSNSQIAPDKSACFKTTRIKSVASDGSSNLK

SEQ ID NO: 2852 - protein, 43 aa, Corononavirus-HKU1
PLAKTRATNLCGLPARNSYHASCHCHLLNLRLICCNIRQATFT

SEQ ID NO: 2853 - protein, 22 aa, Corononavirus-HKU1
DCSKEKNGPLTTTDHLHTVKKL

SEQ ID NO: 2854 - protein, 5 aa, Corononavirus-HKU1
ASNCC

SEQ ID NO: 2855 - protein, 19 aa, Corononavirus-HKU1
SNPNELCTAEISAKDKFSY

SEQ ID NO: 2856 - protein, 6 aa, Corononavirus-HKU1
YKILSA

SEQ ID NO: 2857 - protein, 53 aa, Corononavirus-HKU1
KSLHFNLVTSMPSQKTLPSILPKTSPTVREIDLKLTPSTVSKTSIFLANKTQT

SEQ ID NO: 2858 - protein, 5 aa, Corononavirus-HKU1
LTVAL

SEQ ID NO: 2859 - protein, 6 aa, Corononavirus-HKU1
KEPSHT

SEQ ID NO: 2860 - protein, 5 aa, Corononavirus-HKU1
PKSLP

SEQ ID NO: 2861 - protein, 36 aa, Corononavirus-HKU1
IELGHSKYLTVLTPLITSNLLIRRQSLGRLVILDNK

SEQ ID NO: 2862 - protein, 10 aa, Corononavirus-HKU1
SRTSLFNCIS

SEQ ID NO: 2863 - protein, 53 aa, Corononavirus-HKU1
RSNKTSCITEEFETKQSSPLKKSLYASVSNLITRPTLAVNLTANALVPTTEVI

SEQ ID NO: 2864 - protein, 22 aa, Corononavirus-HKU1
IISKSSLLLLTRITCLSTTPRR

SEQ ID NO: 2865 - protein, 22 aa, Corononavirus-HKU1
VNDTSAGTLNIPADMRVDKQQS

SEQ ID NO: 2866 - protein, 5 aa, Corononavirus-HKU1
LLRCL

SEQ ID NO: 2867 - protein, 6 aa, Corononavirus-HKU1
ARANKT

SEQ ID NO: 2868 - protein, 26 aa, Corononavirus-HKU1
DCLPSCLASGPTILRIVLHNLPPVET

SEQ ID NO: 2869 - protein, 74 aa, Corononavirus-HKU1
QSPTWQTPLDLTIAAVSLENFLPAATAIAFATPPPWSICPLAGLTITSALTSLATFIISPLTKHTLGVIHKPYN

SEQ ID NO: 2870 - protein, 12 aa, Corononavirus-HKU1
GNSKEDILNDIP

SEQ ID NO: 2871 - protein, 28 aa, Corononavirus-HKU1
PTIKSNLSPLNLVTNLPSICSSPITATE

SEQ ID NO: 2872 - protein, 49 aa, Corononavirus-HKU1
QTFTSTAHAAIKIFLGVQKAQKLSSNNEKCNVQGKSAAIRVILCPHLQT

SEQ ID NO: 2873 - protein, 5 aa, Corononavirus-HKU1
DTISP

SEQ ID NO: 2874 - protein, 33 aa, Corononavirus-HKU1
KNKASKPFKSKEKPHFKQHQLAYALISNWFKNQ

SEQ ID NO: 2875 - protein, 8 aa, Corononavirus-HKU1
AKSATKPP

SEQ ID NO: 2876 - protein, 12 aa, Corononavirus-HKU1
GKTIALGIVVSK

SEQ ID NO: 2877 - protein, 4 aa, Corononavirus-HKU1
STKL

SEQ ID NO: 2878 - protein, 52 aa, Corononavirus-HKU1
DNHIFSIAKSLNLKGNFCITSNTERNQQLVCVIVGDHKPLTLKYVSVSTLEP

SEQ ID NO: 2879 - protein, 7 aa, Corononavirus-HKU1
LTNKASL

SEQ ID NO: 2880 - protein, 9 aa, Corononavirus-HKU1
TSLKTKRAL

SEQ ID NO: 2881 - protein, 4 aa, Corononavirus-HKU1
VSKS

SEQ ID NO: 2882 - protein, 212 aa, Corononavirus-HKU1
ILSISSTSSPVTTIWSSLSPVTISSSLLSPVTTSSSSLSPVTTSSSSLSPVTTSSSSLSPVTTSSSSLSPVTTSSSSLSPVTTSSSSLSPVTTSSSSLSPVTTSSSSLSPVTTSSSSLSPVTTSSSSLSPVTTSSSSLSPVTTSSSSLSPVTTSSSSLSPVTTSSSSLIVSSTTPSIVSSTASLLITSSTSSIAKVQYIREAIASSPASSNK

SEQ ID NO: 2883 - protein, 13 aa, Corononavirus-HKU1
TTFSLSLFKNART

SEQ ID NO: 2884 - protein, 82 aa, Corononavirus-HKU1
PTTGCSLQEFKAFSIASQTTATKSSTVTPFSTSNSEQTLPKISSKVESKSNITLTVIKDGISITTGFSLKLTFLPAHGKRQA

SEQ ID NO: 2885 - protein, 37 aa, Corononavirus-HKU1
SKRQIFLSFMTIGKNLSPHLPMYILSIIQIFSTDLGG

SEQ ID NO: 2886 - protein, 25 aa, Corononavirus-HKU1
DDKEDLTFSITSSSTITDSATPSKK

SEQ ID NO: 2887 - protein, 21 aa, Corononavirus-HKU1
ICCSCALHGKTKPGINPVLTL

SEQ ID NO: 2888 - protein, 35 aa, Corononavirus-HKU1
NLLPTIQTKPLIVLRTGISFKTSTVTHSNNNLKKV

SEQ ID NO: 2889 - protein, 8 aa, Corononavirus-HKU1
NLLTKILA

SEQ ID NO: 2890 - protein, 11 aa, Corononavirus-HKU1
SGIKATKLKLA

SEQ ID NO: 2891 - protein, 10 aa, Corononavirus-HKU1
DTTKRPFNNW

SEQ ID NO: 2892 - protein, 31 aa, Corononavirus-HKU1
RSQPVAGALASNMVLNQLTILLTSVVPNNLN

SEQ ID NO: 2893 - protein, 6 aa, Corononavirus-HKU1
VTNLLT

SEQ ID NO: 2894 - protein, 25 aa, Corononavirus-HKU1
NVATETLSINKIHIFKHISETSCEN

SEQ ID NO: 2895 - protein, 10 aa, Corononavirus-HKU1
DIKDVKKIPL

SEQ ID NO: 2896 - protein, 40 aa, Corononavirus-HKU1
LRGIKPSSKKGTKPSPQTANLQAKSARRLTNKSIFFRSIL

SEQ ID NO: 2897 - protein, 18 aa, Corononavirus-HKU1
SPLLSNSCLHQELLTPRI

SEQ ID NO: 2898 - protein, 9 aa, Corononavirus-HKU1
FCSRLPHLH

SEQ ID NO: 2899 - protein, 17 aa, Corononavirus-HKU1
VIRAVSLTIDLQPTTPE

SEQ ID NO: 2900 - protein, 4 aa, Corononavirus-HKU1
TKSS

SEQ ID NO: 2901 - protein, 28 aa, Corononavirus-HKU1
DLTEDLIIGIHNPGRGDQYIQEPNGVTE

SEQ ID NO: 2902 - protein, 36 aa, Corononavirus-HKU1
PYKLKESWLTVSVLLVNNTGFSGITPDDWALTSLES

SEQ ID NO: 2903 - protein, 19 aa, Corononavirus-HKU1
TVQHNGQEKPSIILPETQP

SEQ ID NO: 2904 - protein, 10 aa, Corononavirus-HKU1
KSQLSLKQST

SEQ ID NO: 2905 - protein, 24 aa, Corononavirus-HKU1
PYCITKPQSHKSTLYIDLIEKSSI

SEQ ID NO: 2906 - protein, 86 aa, Corononavirus-HKU1
VITFIKLGSFKTIASADNKCTGSRITTSPSTTSSVGCATYLIPQIVAIVCRRITNRESRTTCQATTISKSQLASHTDCFCLISCKE

SEQ ID NO: 2907 - protein, 8 aa, Corononavirus-HKU1
RQSANLPE

SEQ ID NO: 2908 - protein, 21 aa, Corononavirus-HKU1
SQPYWSTKSTGLIPRYCLSKA

SEQ ID NO: 2909 - protein, 11 aa, Corononavirus-HKU1
AFCEYLPLGSA

SEQ ID NO: 2910 - protein, 7 aa, Corononavirus-HKU1
ASSTLKS

SEQ ID NO: 2911 - protein, 20 aa, Corononavirus-HKU1
SSNLKFEIIKSLSSIYNLQN

SEQ ID NO: 2912 - protein, 26 aa, Corononavirus-HKU1
DGIKPKGTIQPKKSSPKLVVDVVIER

SEQ ID NO: 2913 - protein, 48 aa, Corononavirus-HKU1
RLVLYERNKPITYPLGKPPKLCKGDLIKIAVPDFTAVLVRTSTTCRSS

SEQ ID NO: 2914 - protein, 25 aa, Corononavirus-HKU1
TKISRIRFDCTCHSCPRMQRQSIFT

SEQ ID NO: 2915 - protein, 8 aa, Corononavirus-HKU1
TNPTLSIA

SEQ ID NO: 2916 - protein, 73 aa, Corononavirus-HKU1
PVEGHNPPSSDFIGLANSSAASGSSQRNSGAHLKPRPYLLVLIIATYGRDAEDNQHVTGREMKSVESKIQDYD

SEQ ID NO: 2917 - protein, 25 aa, Corononavirus-HKU1
TTLTSMDNRESCLKSLDLMRSDKRS

SEQ ID NO: 2918 - protein, 12 aa, Corononavirus-HKU1
ADRRYGRNSLLF

---

What is claimed:

1. An isolated nucleic acid molecule comprising the nucleotide sequence of SEQ ID NO:3 or the complement thereof.

2. An isolated nucleic acid molecule comprising a nucleotide sequence having at least 45, 100, 150, 200, 300, 350, 400, 450, 500, 550, 600, 650, 700, 750, 800, 850, 900, 950, 1,000, 1,050, 1,100, 1,150, 1,200, 2,000, 3,000, 4,000, 5,000, 6,000, 7,000, 8,000, 9,000, 10,000, 11,000, 12,000, 13,000, 14,000, 15,000, 16,000, 17,000, 18,000, 19,000, 20,000, 21,000, 22,000, 23,000, 24,000, 25,000, 26,000, 27,000, 28,000, or 29,000 contiguous nucleotides of the nucleotide sequence of SEQ ID NO:3, or the complement thereof.

3. The nucleic acid molecule of claim 1 or 2, wherein the molecule is RNA.

4. The nucleic acid molecule of claim 1 or 2, wherein the molecule is DNA.

5. A vector comprising the nucleic acid molecule of claim 4.

6. An isolated host cell comprising the vector of claim 5.

7. An isolated host cell comprising the nucleic acid molecule of claim 4 operably linked to a heterologous promoter.

8. The host cell of claim 7 being a prokaryotic cell.

9. The host cell of claim 7 is an eukaryotic cell.

10. The host cell of claim 9 is a mammalian cell.

11. A method for producing a polypeptide comprising expressing the polypeptide encoded by said DNA from the host cell of claim 6, and recovering the polypeptide.

12. A method for producing a polypeptide comprising expressing the polypeptide encoded by said DNA from the host cell of claim 7, and recovering the polypeptide.

13. A method for preparing a cell or progeny thereof capable of expressing a polypeptide comprising transfecting the cell with the vector of claim 5.

14. A composition comprising a nucleic acid molecule of claim 1 or 2, and a pharmaceutically acceptable carrier.

* * * * *

UNITED STATES PATENT AND TRADEMARK OFFICE
CERTIFICATE OF CORRECTION

PATENT NO. : 7,553,944 B2
APPLICATION NO. : 10/895064
DATED : June 30, 2009
INVENTOR(S) : Kwok Yung Yuen et al.

It is certified that error appears in the above-identified patent and that said Letters Patent is hereby corrected as shown below:

Column 1,
Line 41, "He had history of" should read --He had a history of--.

Column 2,
Line 7, "in these patients." should read --in this patient.--.

Column 6,
Line 52, "may also refers either to" should read --may also refer either to--.

Column 9,
Line 35, "invention prevents or inhibit" should read --invention prevents or inhibits--.
Line 47, "and may neutralizes" should read --and may neutralize--.

Column 18,
Line 28, "and $F(ab)_2$" should read --and $F(ab')2$--.

Column 23,
Line 18, "by an reverse" should read --by a reverse--.

Column 34,
Line 10, "Vietnem" should read --Vietnam--.

Signed and Sealed this

Sixth Day of October, 2009

David J. Kappos
*Director of the United States Patent and Trademark Office*